US011130968B2

(12) United States Patent
O'Shea et al.

(10) Patent No.: US 11,130,968 B2
(45) Date of Patent: *Sep. 28, 2021

(54) HIGH THROUGHPUT ASSAY FOR MEASURING ADENOVIRUS REPLICATION KINETICS

(71) Applicant: Salk Institute for Biological Studies, La Jolla, CA (US)

(72) Inventors: Clodagh O'Shea, San Diego, CA (US); William Partlo, La Jolla, CA (US); Colin Powers, San Diego, CA (US)

(73) Assignee: Salk Institute for Biological Studies, La Jolla, CA (US)

( * ) Notice: Subject to any disclaimer, the term of this patent is extended or adjusted under 35 U.S.C. 154(b) by 29 days.

This patent is subject to a terminal disclaimer.

(21) Appl. No.: 16/109,513

(22) Filed: Aug. 22, 2018

(65) Prior Publication Data

US 2018/0355374 A1 Dec. 13, 2018

Related U.S. Application Data

(63) Continuation of application No. PCT/US2017/019082, filed on Feb. 23, 2017.

(60) Provisional application No. 62/298,649, filed on Feb. 23, 2016.

(51) Int. Cl.
| | | |
|---|---|---|
| *C12N 15/85* | (2006.01) | |
| *C07K 14/075* | (2006.01) | |
| *C12N 15/62* | (2006.01) | |
| *C07K 14/005* | (2006.01) | |
| *C12N 7/00* | (2006.01) | |

(52) U.S. Cl.
CPC ............ *C12N 15/85* (2013.01); *C07K 14/005* (2013.01); *C07K 14/075* (2013.01); *C12N 7/00* (2013.01); *C12N 15/62* (2013.01); *C07K 2319/01* (2013.01); *C07K 2319/60* (2013.01); *C07K 2319/80* (2013.01); *C12N 2015/859* (2013.01); *C12N 2320/12* (2013.01); *C12N 2320/52* (2013.01); *C12N 2710/10331* (2013.01)

(58) Field of Classification Search
None
See application file for complete search history.

(56) References Cited

U.S. PATENT DOCUMENTS

| | | | |
|---|---|---|---|
| 5,559,099 A | 9/1996 | Wickham et al. | |
| 5,670,488 A | 9/1997 | Gregory et al. | |
| 5,677,178 A | 10/1997 | McCormick | |
| 5,731,190 A | 3/1998 | Wickham et al. | |
| 5,801,029 A | 9/1998 | McCormick | |
| 5,846,782 A | 12/1998 | Wickham et al. | |
| 5,846,945 A | 12/1998 | McCormick | |
| 5,856,181 A | 1/1999 | McCormick | |
| 5,922,315 A | 7/1999 | Roy | |
| 5,945,335 A | 8/1999 | Colosi | |
| 5,962,311 A | 10/1999 | Wickham et al. | |
| 5,965,541 A | 10/1999 | Wickham et al. | |
| 5,972,706 A | 10/1999 | McCormick | |
| 6,020,172 A | 2/2000 | Both | |
| 6,069,134 A | 5/2000 | Roth et al. | |
| 6,127,525 A | 10/2000 | Crystal et al. | |
| 6,133,243 A | 10/2000 | Kirn | |
| 6,153,435 A | 11/2000 | Crystal et al. | |
| 6,296,845 B1 | 10/2001 | Sampson et al. | |
| 6,329,190 B1 | 12/2001 | Wickham et al. | |
| 6,410,010 B1 | 6/2002 | Zhang et al. | |
| 6,455,314 B1 | 9/2002 | Wickham et al. | |
| 6,465,253 B1 | 10/2002 | Wickham et al. | |
| 6,475,480 B1 | 11/2002 | Mehtali et al. | |
| 6,506,379 B1 | 1/2003 | Clackson et al. | |
| 6,506,602 B1 | 1/2003 | Stemmer | |
| 6,569,677 B1 | 5/2003 | Legrand et al. | |
| 6,596,268 B1 | 7/2003 | Coffey et al. | |
| 6,635,466 B2 | 10/2003 | Davidson et al. | |
| 6,635,476 B1 | 10/2003 | Murphy | |
| 6,649,157 B2 | 11/2003 | Coffey et al. | |
| 6,737,234 B1 | 5/2004 | Freimuth | |
| 6,740,525 B2 | 5/2004 | Roelvink et al. | |
| 6,797,702 B1 | 9/2004 | Roth et al. | |
| 6,811,774 B2 | 11/2004 | Haddada et al. | |
| 6,824,771 B1 | 11/2004 | Curiel et al. | |
| 6,838,285 B2 | 1/2005 | Farmer et al. | |

(Continued)

FOREIGN PATENT DOCUMENTS

| | | |
|---|---|---|
| CN | 1330715 A | 1/2002 |
| CN | 13 80420 A | 11/2002 |

(Continued)

OTHER PUBLICATIONS

Finke, et al. (2004) "Tracking Fluorescence-Labeled Rabies Virus: Enhanced Green Fluorescent Protein-Tagged Phosphoprotein P Supports Virus Gene Expression and Formation of Infectious Particles", Journal of Virology, 78(22): 12333-43 (Year: 2004).*

Minskaia, et al. (2013) "Protein Coexpression Using FMDV 2A: Effect of 'Linker' Residues", BioMed Research International, vol. 2013, Article ID 291730, 12 pages.*

Ono, et al. (2005) "Noninvasive Visualization of Adenovirus Replication with a Fluorescent Reporter in the E3 Region", Cancer Research, 65(22): 10154-58.*

Liu, et al. (2006) "Oncolytic adenoviral vector carrying the cytosine deaminase gene for melanoma gene therapy", Cancer Gene Therapy, 13: 845-55.*

(Continued)

*Primary Examiner* — Robert M Kelly

(74) *Attorney, Agent, or Firm* — Klarquist Sparkman, LLP

(57) ABSTRACT

Recombinant adenovirus genomes that include a heterologous open reading frame (ORF) and a self-cleaving peptide coding sequence are described. The recombinant adenovirus genomes and recombinant adenoviruses produced by the disclosed genomes can be used, for example, in high-throughput assays to measure virus replication kinetics. Methods for measuring replication kinetics of a recombinant adenovirus are also described.

21 Claims, 13 Drawing Sheets

Specification includes a Sequence Listing.

(56) References Cited

U.S. PATENT DOCUMENTS

| | | |
|---|---|---|
| 6,841,540 B1 | 1/2005 | Curiel et al. |
| 6,849,446 B2 | 2/2005 | Tikoo et al. |
| 6,867,022 B1 | 3/2005 | Imperiale |
| 6,869,936 B1 | 3/2005 | Vogels et al. |
| 6,878,549 B1 | 4/2005 | Vogels et al. |
| 6,905,678 B2 | 6/2005 | Havenga et al. |
| 6,911,199 B2 | 6/2005 | Vigne et al. |
| 6,911,200 B2 | 6/2005 | Yu et al. |
| 6,913,922 B1 | 7/2005 | Bout et al. |
| 6,929,946 B1 | 8/2005 | Vogels et al. |
| 6,951,755 B2 | 10/2005 | Wickham et al. |
| 6,984,635 B1 | 1/2006 | Schreiber et al. |
| 7,001,596 B1 | 2/2006 | Johnson et al. |
| 7,045,347 B2 | 5/2006 | Graham et al. |
| 7,094,398 B1 | 8/2006 | Lieber et al. |
| 7,094,399 B2 | 8/2006 | Otto |
| 7,109,179 B2 | 9/2006 | Roth et al. |
| 7,157,266 B2 | 1/2007 | Freimuth et al. |
| 7,232,899 B2 | 6/2007 | Seggem et al. |
| 7,235,233 B2 | 6/2007 | Havenga et al. |
| 7,247,472 B2 | 7/2007 | Wilson et al. |
| 7,252,817 B2 | 8/2007 | Coffey et al. |
| 7,252,989 B1 | 8/2007 | Zhang et al. |
| 7,256,036 B2 | 8/2007 | Legrand et al. |
| 7,291,498 B2 | 11/2007 | Roy et al. |
| 7,297,542 B2 | 11/2007 | Curiel et al. |
| 7,306,793 B2 | 12/2007 | Haddada et al. |
| 7,332,337 B2 | 2/2008 | van Es et al. |
| 7,344,711 B2 | 3/2008 | Bonastre et al. |
| 7,344,872 B2 | 3/2008 | Gao et al. |
| 7,364,727 B2 | 4/2008 | Li et al. |
| 7,410,954 B2 | 8/2008 | Davidson et al. |
| 7,456,008 B2 | 11/2008 | Lindholm et al. |
| 7,473,418 B2 | 1/2009 | Yu et al. |
| 7,482,156 B2 | 1/2009 | Arroyo et al. |
| 7,491,508 B2 | 2/2009 | Roy et al. |
| 7,510,868 B2 | 3/2009 | Harden et al. |
| 7,589,069 B1 | 9/2009 | Wold et al. |
| 7,611,868 B2 | 11/2009 | Monaci et al. |
| 7,741,099 B2 | 6/2010 | Havenga et al. |
| 7,749,493 B2 | 7/2010 | Havenga et al. |
| 7,754,201 B2 | 7/2010 | Wang et al. |
| 7,906,113 B2 | 3/2011 | Bout et al. |
| 7,943,373 B2 | 5/2011 | Fujiwara et al. |
| 7,951,585 B2 | 5/2011 | Ke |
| 7,968,333 B2 | 6/2011 | Yu et al. |
| 8,105,574 B2 | 1/2012 | Wilson et al. |
| 8,168,168 B2 | 5/2012 | Fueyo et al. |
| 8,231,880 B2 | 7/2012 | Roy et al. |
| 8,470,310 B2 | 6/2013 | Roy et al. |
| 8,524,219 B2 | 9/2013 | Roy et al. |
| 8,603,459 B2 | 12/2013 | Wilson et al. |
| 8,685,387 B2 | 4/2014 | Roy et al. |
| 8,715,642 B2 | 5/2014 | Kochanek et al. |
| 8,765,146 B2 | 7/2014 | Bruder et al. |
| 8,765,463 B2 | 7/2014 | Harden et al. |
| 8,815,563 B2 | 8/2014 | Davis et al. |
| 8,834,863 B2 | 9/2014 | Roy et al. |
| 8,846,031 B2 | 9/2014 | Roy et al. |
| 8,865,182 B2 | 10/2014 | Mayall et al. |
| 8,920,813 B2 | 12/2014 | Bruder et al. |
| 8,940,290 B2 | 1/2015 | Roy et al. |
| 8,974,777 B2 | 3/2015 | Cascallo et al. |
| 9,017,672 B2 | 4/2015 | Yu et al. |
| 9,018,182 B2 | 4/2015 | Koh et al. |
| 9,056,090 B2 | 6/2015 | Colloca et al. |
| 9,061,055 B2 | 6/2015 | Fueyo et al. |
| 9,133,483 B2 | 9/2015 | Wilson et al. |
| 9,163,261 B2 | 10/2015 | Kollipara et al. |
| 9,187,733 B2 | 11/2015 | O'Shea et al. |
| 9,200,041 B2 | 12/2015 | Lieber et al. |
| 9,206,238 B2 | 12/2015 | Roy et al. |
| 9,217,159 B2 | 12/2015 | Roy et al. |
| 9,217,160 B2 | 12/2015 | O'Shea et al. |
| 9,267,153 B2 | 2/2016 | Curiel |
| 9,315,827 B2 | 4/2016 | Wang et al. |
| 9,359,618 B2 | 6/2016 | Roy et al. |
| 9,382,551 B2 | 7/2016 | Roy et al. |
| 9,410,129 B2 | 8/2016 | Ranki et al. |
| 9,476,061 B2 | 10/2016 | Baker et al. |
| 9,493,745 B2 | 11/2016 | Lee et al. |
| 9,555,089 B2 | 1/2017 | Shiratsuchi et al. |
| 9,593,346 B2 | 3/2017 | Roy et al. |
| 9,597,363 B2 | 3/2017 | Roy et al. |
| 9,682,133 B2 | 6/2017 | Crystal et al. |
| 9,688,727 B2 | 6/2017 | Lieber et al. |
| 9,714,435 B2 | 7/2017 | Dicks et al. |
| 9,718,863 B2 | 8/2017 | Colloca et al. |
| 9,790,519 B2 | 10/2017 | Wei et al. |
| 9,885,090 B2 | 2/2018 | O'Shea et al. |
| 9,913,866 B2 | 3/2018 | O'Shea et al. |
| 10,016,470 B2 | 7/2018 | Bonastre et al. |
| 10,034,905 B2 | 7/2018 | Seymour et al. |
| 10,046,067 B2 | 8/2018 | Yun et al. |
| 10,066,215 B2 | 9/2018 | Lee et al. |
| 10,071,126 B2 | 9/2018 | Kumon et al. |
| 10,077,430 B2 | 9/2018 | Lee et al. |
| 10,080,774 B2 | 9/2018 | Fueyo et al. |
| 10,113,182 B2 | 10/2018 | Roy et al. |
| 10,149,873 B2 | 12/2018 | Roy et al. |
| 10,150,798 B2 | 12/2018 | Lieber et al. |
| 10,155,930 B2 | 12/2018 | Holm |
| 10,232,053 B2 | 3/2019 | Hicklin et al. |
| 10,272,162 B2 | 4/2019 | McVey et al. |
| 10,294,493 B2 | 5/2019 | Wang et al. |
| 10,316,065 B2 | 6/2019 | Carrió et al. |
| 10,376,549 B2 | 8/2019 | Shayakhmetov et al. |
| 10,391,183 B2 | 8/2019 | Fueyo-Margareto et al. |
| 10,501,757 B2 | 12/2019 | Roy et al. |
| 10,538,744 B2 | 1/2020 | Holm |
| 10,544,192 B2 | 1/2020 | Colloca et al. |
| 10,604,549 B2 | 3/2020 | Alemany Bonastre et al. |
| 10,611,803 B2 | 4/2020 | Lieber et al. |
| 10,617,729 B2 | 4/2020 | Dobbins |
| 10,738,325 B2 | 8/2020 | O'Shea et al. |
| 2001/0039046 A1 | 11/2001 | Yeh et al. |
| 2002/0037274 A1 | 3/2002 | Williams et al. |
| 2002/0086411 A1 | 7/2002 | Holm et al. |
| 2002/0001063 A1 | 8/2002 | Young et al. |
| 2002/0142989 A1 | 10/2002 | Alemany et al. |
| 2002/0151069 A1 | 10/2002 | Korokhov |
| 2002/0168343 A1 | 11/2002 | Curiel et al. |
| 2002/0187128 A1 | 12/2002 | Imperiale |
| 2002/0193327 A1 | 12/2002 | Nemerow |
| 2002/0193328 A1 | 12/2002 | Ketner |
| 2003/0001713 A1 | 1/2003 | Havenga et al. |
| 2003/0021768 A1 | 1/2003 | Shen |
| 2003/0027338 A1 | 2/2003 | Freimuth |
| 2003/0073072 A1 | 4/2003 | Havenga et al. |
| 2003/0082146 A1 | 5/2003 | van Es |
| 2003/0082150 A1 | 5/2003 | Falleur et al. |
| 2003/0082811 A1 | 5/2003 | Orlando et al. |
| 2003/0092162 A1 | 5/2003 | Shankara et al. |
| 2003/0095989 A1 | 5/2003 | Irving et al. |
| 2003/0099615 A1 | 5/2003 | Tikoo |
| 2003/0099619 A1 | 5/2003 | Wickham et al. |
| 2003/0104625 A1 | 6/2003 | Cheng et al. |
| 2003/0138405 A1 | 7/2003 | Fueyo et al. |
| 2003/0143730 A1 | 7/2003 | Blanche et al. |
| 2003/0166286 A1 | 9/2003 | Wickham et al. |
| 2003/0170899 A1 | 9/2003 | McVey et al. |
| 2003/0175244 A1 | 9/2003 | Curiel et al. |
| 2003/0175245 A1 | 9/2003 | Brough et al. |
| 2003/0215948 A1 | 11/2003 | Kaleko et al. |
| 2003/0219899 A1 | 11/2003 | Korokhov |
| 2003/0220284 A1 | 11/2003 | Yotnda et al. |
| 2004/0002060 A1 | 1/2004 | Kaleko et al. |
| 2004/0038205 A1 | 2/2004 | Van Raaij et al. |
| 2004/0001023 A1 | 5/2004 | Schughart et al. |
| 2004/0091456 A1 | 5/2004 | Nakai et al. |
| 2004/0146489 A1 | 7/2004 | Yu et al. |
| 2004/0175362 A1 | 9/2004 | Curiel et al. |
| 2004/0185555 A1 | 9/2004 | Emini et al. |
| 2004/0191222 A1 | 9/2004 | Emini et al. |

(56) References Cited

U.S. PATENT DOCUMENTS

| | | |
|---|---|---|
| 2004/0191761 A1 | 9/2004 | Routes |
| 2004/0213764 A1 | 10/2004 | Wold et al. |
| 2004/0219516 A1 | 11/2004 | Bennett et al. |
| 2004/0219543 A1 | 11/2004 | Wirtz |
| 2004/0265277 A1 | 12/2004 | Holm |
| 2005/0032045 A1 | 2/2005 | Tikoo et al. |
| 2005/0036989 A1 | 2/2005 | Shen et al. |
| 2005/0079158 A1 | 4/2005 | Zhou et al. |
| 2005/0095231 A1 | 5/2005 | Curiel et al. |
| 2005/0095705 A1 | 5/2005 | Kadan et al. |
| 2005/0169891 A1 | 8/2005 | Vogels et al. |
| 2005/0181507 A1 | 8/2005 | Havenga et al. |
| 2005/0186178 A1 | 8/2005 | Ennist |
| 2005/0201936 A1 | 9/2005 | Wold et al. |
| 2005/0201978 A1 | 9/2005 | Lipton |
| 2005/0232900 A1 | 10/2005 | Vogels et al. |
| 2005/0238622 A1 | 10/2005 | Axelrod et al. |
| 2005/0260162 A1 | 11/2005 | Fueyo et al. |
| 2005/0271622 A1 | 12/2005 | Zhou et al. |
| 2005/0277193 A1 | 12/2005 | Wickham et al. |
| 2005/0287120 A1 | 12/2005 | Fisher et al. |
| 2006/0002893 A1 | 1/2006 | Vigne et al. |
| 2006/0034804 A1 | 2/2006 | Gregory et al. |
| 2006/0099178 A1 | 5/2006 | Holm |
| 2006/0104953 A1 | 5/2006 | Havenga et al. |
| 2006/0140910 A1 | 6/2006 | Gregory et al. |
| 2006/0147420 A1 | 7/2006 | Fueyo et al. |
| 2006/0182718 A1 | 8/2006 | Roth et al. |
| 2006/0211115 A1 | 9/2006 | Roy et al. |
| 2006/0228334 A1 | 10/2006 | Calatrava et al. |
| 2006/0257370 A1 | 11/2006 | Hermiston et al. |
| 2006/0281090 A1 | 12/2006 | Lieber et al. |
| 2006/0286121 A1 | 12/2006 | Gall et al. |
| 2006/0292122 A1 | 12/2006 | Hermiston et al. |
| 2006/0292682 A1 | 12/2006 | Hawkins et al. |
| 2007/0003923 A1 | 1/2007 | Nemerow |
| 2007/0110719 A1 | 5/2007 | Holm |
| 2007/0202080 A1 | 8/2007 | Yun et al. |
| 2007/0202524 A1 | 8/2007 | Murphy |
| 2007/0253932 A1 | 11/2007 | Gregory et al. |
| 2007/0254357 A1 | 11/2007 | Gregory et al. |
| 2007/0292396 A1 | 12/2007 | Fueyo et al. |
| 2007/0292954 A1 | 12/2007 | Elledge |
| 2008/0069836 A1 | 3/2008 | Nabel et al. |
| 2008/0089864 A1 | 4/2008 | Bonastre et al. |
| 2008/0108129 A1 | 5/2008 | Pitcovski et al. |
| 2008/0112929 A1 | 5/2008 | Kovesdi et al. |
| 2008/0118470 A1 | 5/2008 | Ennist et al. |
| 2008/0124360 A1 | 5/2008 | Seggern |
| 2008/0213220 A1 | 9/2008 | Fisher et al. |
| 2008/0242608 A1 | 10/2008 | Bonni et al. |
| 2008/0247996 A1 | 10/2008 | Yu et al. |
| 2008/0254059 A1 | 10/2008 | Bett et al. |
| 2009/0074810 A1 | 3/2009 | Roy et al. |
| 2009/0111144 A1 | 4/2009 | Bebbington |
| 2009/0202565 A1 | 8/2009 | Labow et al. |
| 2009/0232800 A1 | 9/2009 | Holm |
| 2009/0280089 A1 | 11/2009 | Benihoud et al. |
| 2009/0311219 A1 | 12/2009 | Bonastre et al. |
| 2010/0008977 A1 | 1/2010 | Boulikas et al. |
| 2010/0034774 A1 | 2/2010 | Vogels et al. |
| 2010/0047208 A1 | 2/2010 | Ke |
| 2010/0075951 A1 | 3/2010 | Cardin et al. |
| 2010/0075998 A1 | 3/2010 | Vanotti et al. |
| 2010/0098668 A1 | 4/2010 | Seth |
| 2010/0151576 A1 | 6/2010 | Li et al. |
| 2010/0233125 A1 | 9/2010 | Tagawa |
| 2010/0272753 A1 | 10/2010 | Ketner et al. |
| 2010/0292166 A1 | 11/2010 | Lee et al. |
| 2010/0310554 A1 | 12/2010 | Holm |
| 2010/0311145 A1 | 12/2010 | Holm |
| 2011/0053249 A1 | 3/2011 | Bonastre et al. |
| 2011/0059135 A1 | 3/2011 | Kovesdi et al. |
| 2011/0086063 A1 | 4/2011 | Crystal et al. |
| 2011/0104788 A1 | 5/2011 | Baker et al. |
| 2011/0189234 A1 | 8/2011 | Van Beusechem et al. |
| 2011/0256524 A1 | 10/2011 | Lee et al. |
| 2011/0275093 A1 | 11/2011 | Holm |
| 2011/0286999 A1 | 11/2011 | Holm |
| 2012/0020924 A1 | 1/2012 | Nakai et al. |
| 2012/0039877 A1 | 2/2012 | Holm |
| 2012/0207711 A1 | 8/2012 | Fueyo et al. |
| 2013/0058897 A1 | 3/2013 | Lee et al. |
| 2013/0101557 A1 | 4/2013 | Yun et al. |
| 2013/0231267 A1 | 9/2013 | O'Shea et al. |
| 2013/0243729 A1 | 9/2013 | O'Shea et al. |
| 2013/0243731 A1 | 9/2013 | Dias et al. |
| 2013/0323205 A1 | 12/2013 | Diaconu et al. |
| 2013/0345295 A1 | 12/2013 | Wang et al. |
| 2014/0023619 A1 | 1/2014 | Kosai et al. |
| 2014/0199688 A1 | 7/2014 | Mizuguchi et al. |
| 2014/0294890 A1 | 10/2014 | Ketner et al. |
| 2014/0341857 A1 | 11/2014 | Bressy et al. |
| 2014/0348791 A1 | 11/2014 | Barouch et al. |
| 2014/0377294 A1 | 12/2014 | Fueyo-Margareto et al. |
| 2014/0377295 A1 | 12/2014 | Ertl et al. |
| 2015/0005397 A1 | 1/2015 | O'Shea et al. |
| 2015/0017127 A1 | 1/2015 | O'Shea et al. |
| 2015/0071881 A1 | 3/2015 | Bonastre et al. |
| 2015/0086579 A1 | 3/2015 | Mayall et al. |
| 2015/0202324 A1 | 7/2015 | Hemminki et al. |
| 2015/0232880 A1 | 8/2015 | Hemminki et al. |
| 2015/0246949 A1 | 9/2015 | Lieber et al. |
| 2015/0352203 A1 | 12/2015 | Wilson et al. |
| 2015/0374766 A1 | 12/2015 | O'Shea et al. |
| 2016/0017294 A1 | 1/2016 | Reid et al. |
| 2016/0051603 A1 | 2/2016 | Roy et al. |
| 2016/0053235 A1 | 2/2016 | O'Shea et al. |
| 2016/0082100 A1 | 3/2016 | Ranki et al. |
| 2016/0090574 A1 | 3/2016 | Fisher et al. |
| 2016/0102295 A1 | 4/2016 | Roy et al. |
| 2016/0143967 A1 | 5/2016 | Fueyo-Margareto et al. |
| 2016/0208287 A1 | 7/2016 | Hemminki et al. |
| 2016/0244783 A1 | 8/2016 | Roy et al. |
| 2016/0289645 A1 | 10/2016 | Tufaro et al. |
| 2017/0035818 A1 | 2/2017 | Seymour et al. |
| 2017/0073647 A1 | 3/2017 | Fisher et al. |
| 2017/0080069 A1 | 3/2017 | Cerullo et al. |
| 2017/0096646 A1 | 4/2017 | Roy et al. |
| 2017/0137786 A1 | 5/2017 | Hemminki et al. |
| 2017/0183636 A1 | 6/2017 | Roy et al. |
| 2017/0190752 A1 | 7/2017 | Holm |
| 2017/0202893 A1 | 7/2017 | O'Shea et al. |
| 2017/0252443 A1 | 9/2017 | Holm |
| 2017/0314044 A1 | 11/2017 | Davydova et al. |
| 2017/0348405 A1 | 12/2017 | Shiratsuchi et al. |
| 2018/0000966 A1 | 1/2018 | Dicks et al. |
| 2018/0051301 A1 | 2/2018 | Rentschler et al. |
| 2018/0072809 A1 | 3/2018 | Hemminki et al. |
| 2018/0100164 A1 | 4/2018 | Wei et al. |
| 2018/0104288 A1 | 4/2018 | Galili et al. |
| 2018/0163190 A1 | 6/2018 | Gerardy-Schahn et al. |
| 2018/0216081 A1 | 8/2018 | Colloca et al. |
| 2018/0221423 A1 | 8/2018 | O'Shea et al. |
| 2018/0318365 A1 | 11/2018 | Yeung et al. |
| 2018/0346929 A1 | 12/2018 | Kosai et al. |
| 2018/0355374 A1 | 12/2018 | O'Shea et al. |
| 2018/0355379 A1 | 12/2018 | O'Shea et al. |
| 2018/0369417 A1 | 12/2018 | Yun et al. |
| 2019/0055522 A1 | 2/2019 | Holm |
| 2019/0062395 A1 | 2/2019 | Merchant et al. |
| 2019/0070233 A1 | 3/2019 | Yeung et al. |
| 2019/0093085 A1 | 3/2019 | Tufaro et al. |
| 2019/0136204 A1 | 5/2019 | Reid et al. |
| 2019/0142967 A1 | 5/2019 | Hicklin et al. |
| 2019/0175716 A1 | 6/2019 | Gilbert et al. |
| 2019/0183946 A1 | 6/2019 | Bonastre et al. |
| 2019/0201462 A1 | 7/2019 | Tufaro et al. |
| 2019/0201551 A1 | 7/2019 | Curiel |
| 2019/0233845 A1 | 8/2019 | Maloveste et al. |
| 2019/0247452 A1 | 8/2019 | Lan et al. |
| 2019/0269794 A1 | 9/2019 | McVey et al. |
| 2019/0275092 A1 | 9/2019 | Tufaro et al. |
| 2019/0275093 A1 | 9/2019 | Aboody et al. |

(56) References Cited

U.S. PATENT DOCUMENTS

| | | |
|---|---|---|
| 2019/0300905 A1 | 10/2019 | Ammendola et al. |
| 2019/0314523 A1 | 10/2019 | O'Shea et al. |
| 2019/0314525 A1 | 10/2019 | O'Shea et al. |
| 2019/0345204 A1 | 11/2019 | Carrió et al. |
| 2019/0350992 A1 | 11/2019 | Cascallo Piqueras et al. |
| 2019/0352616 A1 | 11/2019 | Reid et al. |
| 2019/0352669 A1 | 11/2019 | Reid et al. |
| 2019/0374589 A1 | 12/2019 | Suzuki et al. |
| 2019/0388487 A1 | 12/2019 | Shayakhmetov et al. |
| 2020/0014798 A1 | 1/2020 | Hicklin et al. |
| 2020/0032223 A1 | 1/2020 | Reid et al. |
| 2020/0078415 A1 | 3/2020 | Reid et al. |
| 2020/0095560 A1 | 3/2020 | Holm |
| 2020/0102352 A1 | 4/2020 | Colloca et al. |

FOREIGN PATENT DOCUMENTS

| | | |
|---|---|---|
| CN | 102191245 A | 9/2011 |
| EP | 0689447 | 4/1999 |
| EP | 0931830 | 3/2001 |
| EP | 0760675 | 8/2001 |
| EP | 1167533 | 1/2002 |
| EP | 1284294 | 2/2003 |
| EP | 1413586 | 4/2004 |
| EP | 1196616 | 12/2004 |
| EP | 1185279 | 1/2005 |
| EP | 0851769 | 2/2005 |
| EP | 0861329 | 3/2005 |
| EP | 1181382 | 3/2005 |
| EP | 1121137 | 7/2005 |
| EP | 0991763 | 9/2005 |
| EP | 1294918 | 10/2005 |
| EP | 0889969 | 11/2005 |
| EP | 1498129 | 11/2005 |
| EP | 1593742 | 11/2005 |
| EP | 0920524 | 12/2005 |
| EP | 1307573 | 1/2006 |
| EP | 0978566 | 5/2006 |
| EP | 0778889 | 7/2006 |
| EP | 1070118 | 10/2006 |
| EP | 1214098 | 11/2006 |
| EP | 1230378 | 6/2007 |
| EP | 1550722 | 6/2007 |
| EP | 1187919 | 11/2007 |
| EP | 0863987 | 1/2008 |
| EP | 0920514 | 1/2008 |
| EP | 1159438 | 7/2008 |
| EP | 1266022 | 10/2008 |
| EP | 1678193 | 12/2008 |
| EP | 1054064 | 12/2009 |
| EP | 2012822 | 1/2010 |
| EP | 1816204 | 10/2010 |
| EP | 1749098 | 12/2010 |
| EP | 1799836 | 12/2010 |
| EP | 1816205 | 8/2011 |
| EP | 1818408 | 8/2011 |
| EP | 1409748 | 10/2011 |
| EP | 1180932 | 1/2012 |
| EP | 1466001 | 4/2012 |
| EP | 1743041 | 6/2012 |
| EP | 1446479 | 8/2012 |
| EP | 1649028 | 8/2012 |
| EP | 1990418 | 8/2012 |
| EP | 2311499 | 8/2012 |
| EP | 1636370 | 4/2014 |
| EP | 1767642 | 4/2014 |
| EP | 1689445 | 2/2015 |
| EP | 2350269 | 9/2015 |
| EP | 2403951 | 9/2015 |
| EP | 2643465 | 5/2016 |
| EP | 2428229 | 8/2016 |
| EP | 2459716 | 8/2016 |
| EP | 2220241 | 9/2016 |
| EP | 2325298 | 10/2016 |
| EP | 2379586 | 11/2016 |
| EP | 2220242 | 12/2016 |
| EP | 2774985 | 12/2016 |
| EP | 2163260 | 3/2017 |
| EP | 2580234 | 3/2017 |
| EP | 2798069 | 3/2017 |
| EP | 2855685 | 3/2017 |
| EP | 2900818 | 6/2017 |
| EP | 2301582 | 7/2017 |
| EP | 3049520 | 7/2017 |
| EP | 1453543 | 8/2017 |
| EP | 2463362 | 11/2017 |
| EP | 2558481 | 12/2017 |
| EP | 2682459 | 12/2017 |
| EP | 2714916 | 1/2018 |
| EP | 2391638 | 6/2018 |
| EP | 2563919 | 6/2018 |
| EP | 2971008 | 7/2018 |
| EP | 2606137 | 8/2018 |
| EP | 2855669 | 10/2018 |
| EP | 2986311 | 11/2018 |
| EP | 3145537 | 12/2018 |
| EP | 2654786 | 2/2019 |
| EP | 3280798 | 6/2019 |
| EP | 3029144 | 7/2019 |
| EP | 3150706 | 7/2019 |
| EP | 2809788 | 9/2019 |
| EP | 3071697 | 10/2019 |
| EP | 3274363 | 10/2019 |
| EP | 3460052 | 10/2019 |
| JP | 2005-525779 | 9/2005 |
| JP | 2008-517627 | 5/2008 |
| JP | 2010-527324 | 8/2010 |
| JP | 2011-524904 | 9/2011 |
| WO | WO 96/18418 | 6/1996 |
| WO | WO 98/54346 | 12/1998 |
| WO | WO 98/55641 | 12/1998 |
| WO | WO 99/44423 | 9/1999 |
| WO | WO 00/03029 | 1/2000 |
| WO | WO 00/22137 | 4/2000 |
| WO | WO 00/42208 | 7/2000 |
| WO | WO 01/02431 | 1/2001 |
| WO | WO 01/004282 | 1/2001 |
| WO | WO 01/21217 | 3/2001 |
| WO | WO 01/23004 | 4/2001 |
| WO | WO 01/90392 | 11/2001 |
| WO | WO 01/98513 | 12/2001 |
| WO | WO 02/46372 | 6/2002 |
| WO | WO 03/064666 | 8/2003 |
| WO | WO 03/076605 | 9/2003 |
| WO | WO 2003/092579 | 11/2003 |
| WO | WO 03/104467 | 12/2003 |
| WO | WO 2004/018627 | 3/2004 |
| WO | WO 2004/031357 | 4/2004 |
| WO | WO 2005/001103 | 1/2005 |
| WO | WO 2005/023848 | 3/2005 |
| WO | WO 2005/030261 | 4/2005 |
| WO | WO 2005/065348 | 7/2005 |
| WO | WO 2005/075506 | 8/2005 |
| WO | WO 2005/107474 | 11/2005 |
| WO | WO 2005/113781 | 12/2005 |
| WO | WO 2005/117993 | 12/2005 |
| WO | WO 2006/086357 | 8/2006 |
| WO | WO 2006/119449 | 11/2006 |
| WO | WO 2007/124065 | 11/2007 |
| WO | WO 2008/095168 | 8/2008 |
| WO | WO 2008/150496 | 12/2008 |
| WO | WO 2009/065800 | 5/2009 |
| WO | WO 2010/024483 | 3/2010 |
| WO | WO 2010/037027 | 4/2010 |
| WO | WO 2011/133040 | 10/2011 |
| WO | WO 2012/003287 | 1/2012 |
| WO | WO 2012/022496 | 2/2012 |
| WO | WO 2012/024350 | 2/2012 |
| WO | WO 2012/024351 | 2/2012 |
| WO | WO 2012/083297 | 6/2012 |
| WO | WO 2013/036791 | 3/2013 |
| WO | WO 2013/135615 | 9/2013 |
| WO | WO 2013/138505 | 9/2013 |
| WO | WO 2014/000026 | 1/2014 |

(56) References Cited

FOREIGN PATENT DOCUMENTS

| | | |
|---|---|---|
| WO | WO 2014/153204 | 9/2014 |
| WO | WO 2014/170389 | 10/2014 |
| WO | WO 2015/155370 | 10/2015 |
| WO | WO 2016/049201 | 3/2016 |
| WO | WO 2017/062511 | 4/2017 |
| WO | WO 2017/147265 | 8/2017 |
| WO | WO 2017/147269 | 8/2017 |
| WO | WO 2018/078220 | 5/2018 |
| WO | WO 2018/083257 | 5/2018 |
| WO | WO 2018/083258 | 5/2018 |
| WO | WO 2018/083259 | 5/2018 |
| WO | WO 2018/104919 | 6/2018 |
| WO | WO 2018/201017 | 11/2018 |
| WO | WO 2018/204677 | 11/2018 |
| WO | WO 2018/218083 | 11/2018 |
| WO | WO 2019/016756 | 1/2019 |
| WO | WO 2019/057745 | 3/2019 |
| WO | WO 2019/073059 | 4/2019 |
| WO | WO 2019/086450 | 5/2019 |
| WO | WO 2019/086456 | 5/2019 |
| WO | WO 2019/086461 | 5/2019 |
| WO | WO 2019/086466 | 5/2019 |
| WO | WO 2019/158914 | 8/2019 |
| WO | WO 2019/179977 | 9/2019 |
| WO | WO 2019/179979 | 9/2019 |
| WO | WO 2019/191494 | 10/2019 |
| WO | WO 2019/199859 | 10/2019 |
| WO | WO 2019/202118 | 10/2019 |
| WO | WO 2019/239311 | 12/2019 |
| WO | WO 2020/014539 | 1/2020 |
| WO | WO 2020/046130 | 3/2020 |
| WO | WO 2020/076820 | 4/2020 |

OTHER PUBLICATIONS

Mohr (2005) "To replicate or not to replicate: achieving selective oncolytic virus replication in cancer cells through translational control", Oncogene, 24: 7697-709.*
Chopra (Dec. 9, 2007; Updated Jan. 2, 2008) "Recombinant Adenovirus with Enhanced Green Fluorescent Protein", In: Molecular Imaging and Contrast Agent Database (MICAD) [Internet]. Bethesda (MD): National Center for Biotechnology Information (US); 2004-2013), 5 pages as printed.*
Funston et al., "Expression of heterologous genes in oncolytic adenoviruses using picornaviral 2A sequences that trigger ribosome skipping,"*J Gen Virol* 89:389-396, 2008.
Funston et al., "Expression of Heterologous Genes in Oncolytic Adenoviruses using Picornaviral 2A Sequences that Trigger Ribosome Skipping," *J. Gen. Virol.*, vol. 89:389-396, 2008.
Ketzer et al., "Synthetic riboswitches for external regulation of genes transferred by replication-deficient and oncolytic adenoviruses," *Nucleic Acids Res* 40(21):e167 (10 pages), 2012.
Kim et al., "High Cleavage Efficiency of a 2A Peptide Derived from Porcine Teschovirus-1 in Human Cell Lines, Zebrafish and Mice," *PLoS ONE*, vol. 64:e18556, 2011.
Pelka et al., "Adenovirus E1A Directly Targets the E2F/DP-1 Complex," *J. Virol.*, vol. 85:8841-8851, 2011.
Szymczak et al., "Correction of Multi-Gene Deficiency in vivo using a Single 'self-cleaving' 2A Peptide-Based Retroviral Vector," *Nature Biotech.*, vol. 22:589-594, 2004.
Tan et al., "Coexpression of double or triple copies of the rabies virus glycoprotein gene using a 'self-cleaving' 2A peptide-based replication-defective human adenovirus serotype 5 vector," *Biologicals* 38:586-593, 2010.
Alba et al., "Gutless adenovirus: last-generation adenovirus for gene therapy," Gene Ther., vol. 12:S18-S27, 2005.
Alba et al., "Identification of coagulation factor (F)X binding sites on the adenovirus serotype 5 hexon: effect of mutagenesis on FX interactions and gene transfer," Blood, vol. 114(5): 965-971, 2009.
Alonso et al., "Combination of the oncolytic adenovirus ICOVIR-5 with chemotherapy provides enhanced anti-glioma effect in vivo," Cancer Gene Ther., vol. 14:756-761,2007.

Barton, et al., "Second-Generation Replication-Competent Oncolytic Adenovirus Armed with Improved Suicide Genes and ADP Gene Demonstrates Greater Efficacy without Increased Toxicity", Molecular Therapy, 2006, 13(2):347-356.
Batzer et al., "Enhanced evolutionary PCR using oligonucleotides with inosine at the 3'-terminus", Nucleic Acid Research, 1991, 19(18):5081.
Bauerschmitz et al., "Tissue-Specific Promoters Active in CD44+ CD24-1low Breast Cancer Cells," Cancer Res., vol. 68(14):5533-5539, 2008.
Bayle et al., "Rapamycin Analogs with Differential Binding Specificity Permit Orthogonal Control of Protein Activity," Chem Biol., vol. 13:99-107, 2006.
Behar et al., "Llama Single-Domain Antibodies Directed against Nonconventional Epitopes of Tumor-Associated Carcinoembryonic Antigen Absent from Nonspecific Cross-Reacting Antigen," FEBS J., vol. 276:3881-3893, 2009.
Belousova et al., "Modulation of Adenovirus Vector Tropism via Incorporation of Polypeptide Ligands into the Fiber Protein," J Virol., vol. 76(17):8621-8631, 2002.
Berge et al., "Pharmaceutical Salts", Journal of Pharmaceutical Science, 1977, 66: 1-19.
Bett et al., "DNA sequence of the deletion/insertion in early region 3 of Ad5 dl309," Virus Res., vol. 39: 75-82, 1995.
Binkowski et al., "Ligand-Regulated Peptides: A General Approach for Modulating Protein-Peptide Interactions with Small Molecules," Chem. Biol., vol. 12: 847-855, 2005.
Bradshaw et al., "Biodistribution and inflammatory profiles of novel pen ton and hexon double-mutant serotype 5 adenoviruses," J Control Release 164(3): 394-402, 2012.
Bremnes et al., "The Role of Tumor Stroma in Cancer Progression and Prognosis," J. Thorac. Oncol., vol. 6:209-217, 2011.
Card et al., "MicroRNA silencing improves the tumor specificity of adenoviral transgene expression," Cancer Gene Ther., vol. 19: 451-459, 2012.
Chen et al., "Identification of an 11-kDa FKBP12-rapamycin-binding domain within the 289-kDa FKBP12-rapamycin-associated protein and characterization of a critical serine residue," Proc Natl Acad Sci USA, 92:4947-4951, 1995.
Cheo et al., "Concerted Assembly and Cloning of Multiple DNA Segments Using In Vitro Site-Specific Recombination: Functional Analysis of Multi-Segment Expression Clones," Genome Res., vol. 14:2111-2120, 2004.
Chong et al., "A System for Small-Molecule Control of Conditionally Replication-Competent Adenoviral Vectors," Mol. Ther., vol. 5(2): 195-203, 2002.
Doronin et al., "Overexpression of ADP (E3-11.6K) Protein Increases Cell Lysis and Spread of Adenovirus," Virology 305: 378-387, 2003.
Doronin et al., "Tumor-Specific, Replication-Competent Adenovirus Vectors Overexpressing the Adenovirus Death Protein," J. Virol., vol. 74:6147-6155, 2000.
Evans et al., "Relocalization of the Mre11-Rad50-Nbs1 Complex by the Adenovirus E4 ORF3 Protein Is Required for Viral Replication", Journal of Virology, 2005, 79(10):6207-6215.
Extended European Search Report dated Dec. 11, 2013 for European Application No. 11818698.0, 10 pages.
Extended European Search Report for European Application No. 13760821.2, dated Sep. 30, 2015.
Fang et al., "An Antibody Delivery System for Regulated Expression of Therapeutic Levels of Monoclonal Antibodies In Vivo," Mol. Ther., vol. 15:1153-1159, 2007.
Frese et al., "Selective PDZ protein-dependent stimulation of phosphatidylinositol 3-kinase by the adenovirus E4-ORF1 oncoprotein," Oncogene 22: 710-721, 2003.
Fuerer et al., "Adenoviruses with Tcf binding sites in multiple early promoters show enhanced selectivity for tumour cells with constitutive activation of the wnt signalling pathway," Gene Ther 9:270-281, 2002.
Gall et al., "Construction and Characterization of Hexon-Chimeric Adenoviruses: Specification of Adenovirus Serotype," J Virol 72(12): 10260-10264, 1998.

(56) References Cited

OTHER PUBLICATIONS

Gibson et al., "Enzymatic Assembly of DNA Molecules up to Several Hundred Kilobases," Nature Meth., vol. 6:343-360, 2009.
Glasgow et al., "A Strategy for Adenovirus Vector Targeting with a Secreted Single Chain Antibody," PLoS One, vol. 4:e8355, 2009.
Havenga et al., "Novel Replication-Incompetent Adenoviral B-group Vectors: High Vector Stability and Yield in PER.C6 Cells," J. Gen. Viral., vol. 87:2135-2143, 2006.
Hawkins et al., "Gene delivery from the E3 region of replicating human adenovirus: evaluation of the E3B region," Gene Therapy 8, 1142-1148, 2001.
Heise et al., "An Adenovirus E1A Mutant that Demonstrates Potent and Selective Systemic Anti-Tumoral Efficacy," Nat Med. 6: 1134-1139, 2000.
Helin et al., "Heterodimerization of the Transcription Factors E2F-1 and DP-1 is required for Binding to the Adenovirus E4 (ORF6/7) Protein," J. Virol., 68:5027-5035, 1994.
Henikoff et al., "Amino acid substitution matrices from protein blocks", Proc. Natl. Acad. Sci. USA, 1992, 89:10915-10919.
Hernandez-Aya et al. "Targeting the Phosphatidylinositol 3-Kinase Signaling Pathway in Breast Cancer", The Oncologist, 16, pp. 404-414, 2011.
Holm et al., "Multidrug-resistance Cancer Cells Facilitate E1-independent Adenovirus Replication: Impact for Cancer Gene Therapy," Cancer Res 64:322-328, 2004.
International Preliminary Report on Patentability and Written Opinion dated Feb. 19, 2013 for International Application No. PCT/US2011/048005, 5 pages.
International Search Report dated Mar. 23, 2012 for International Application No. PCT/US2011 /048005, 6 pages.
International Search Report and Written Opinion for PCT/US2019/026626, dated Jun. 24, 2019 (12 pages).
Javier, "Cell polarity proteins: common targets for tumorigenic human viruses," Oncogene 27:7031-7046, 2008.
Johnson et al., "Selectively replicating adenoviruses targeting deregulated E2F activity are potent, systemic antitumor agents," Cancer Cell 1:325-337, 2012.
Kim, "Clinical research results with dl1520 (Onyx-015, a replication-selective adenovims for the treatment of cancer: what have we learned?", Gene Therapy, 2001, 8(2):89-98.
Kovesdi et al., "Role of an Adenovirus E2 Promoter Binding Factor in E1A Mediated Coordinate Gene Control," Proc Nat Acad Sci USA, vol. 84: 2180-2184, 1987.
Leicher et al., "Coexpression of the KCNA3B Gene Product with Kv1 .5 Leads to a Novel A-type Potassium Channel*", The Journal of Biological Chemistry, 1998, 273(52):35095-35101.
Leppard et al., "Adenovirus type 5 E4 Orf3 protein targets promyelocytic leukaemia (PML) protein nuclear domains for disruption via a sequence in PML isoform II that is predicted as protein as a protein interaction site of bioinformatics analysis", Journal of General Virology, 2009, 90(1):95-104.
Li et al., "Harnessing homologous recombination in vitro to generate recombinant DNA via SLIC," Nat Methods, vol. 4(3):251-256, 2007.
Lopez et al., "A Tumor-stroma Targeted Oncolytic Adenovirus Replicated in Human Ovary Cancer Samples and Inhibited Growth of Disseminated Solid Tumors in Mice," Mol. Ther., vol. 20(12):2222-2233, 2012.
McCormick, "Cancer Gene Therapy: Fringe or Cutting Edge?," Nature Rev. Cancer, vol. 1:130-141,2001.

Murakami et al., "Chimeric Adenoviral Vectors Incorporating a Fiber of Human Adenovirus 3 Efficiently Mediate Gene Transfer into Prostate Cancer Cells," The Prostate, vol. 70:362-376, 2009.
NCBI Accession No. CV1 10986, Jan. 11, 2011, 3 pages.
Nevels et al., "The Adenovirus E4orf6 can Promote E1A/E1B-induced Focus Formation by Interfering with p53 Tumor Suppressor Function," Proc. Natl. Acad. Sci. USA, vol. 94:1206-1211, 1997.
Office Action and Search Report from China Application No. 2013 80014047.7, dated Aug. 5, 2015 (English translation).
O'Shea et al., "Adenoviral Proteins Mimic Nutrient/Growth Signals to Activate the mTOR Pathway for Viral Replication," EMBO J., vol. 24:1211-1221, 2005.
O'Shea et al., "Adenovirus Overrides Cellular Checkpoints for Protein Translation," Cell Cycle 4(7):883-888, 2005.
O'Shea et al., "DNA Tumor Viruses—the Spies who Lyse Us," Curr. Opin. Genet. Dev., vol. 15:18-26, 2005.
O'Shea et al., "Viruses—seeking and destroying the tumor program," Oncogene, vol. 24: 7640-7655, 2005.
Pearson et al., "Improved tools for biological sequence comparison", Proc. Natl. Acad. Sci. USA, 1988, 85:2444-2448.
Rossolini et al., "Use of deoxyinosine-containing primers vs degenerate primers for polymerase chain reaction based on ambiguous sequence information", Mol. Cell. Probes, 1994, 8:91-98.
Roy et al., "Rescue of chimeric adenoviral vectors to expand the serotype repertoire," J Virol Methods, vol. 14:41-21, 2007.
Shapiro et al., "Recombinant Adenoviral Vectors Can Induce Expression of p73 via the E4-orf6/7 Protein," J Virol., vol. 80(11):5349-5360, 2006.
Shepard et al., "E4orfl3 Is Necessary for Enhanced S-Phase Replication of Cell Cycle-Restricted Subgroup C Adenoviruses," J Virol 77(15):8593-8595, 2003.
Smith et al., "Comparison of Biosequences", Advances in Applied Mathematics, 1981,2:482-489.
Soria et al., "Heterochromatin silencing of p53 target genes by a small viral protein", Nature, 2010, 466(7310): 1076-1083.
Stanton et al. "Re-engineering adenovirus vector systems to enable high-throughput analyses of gene function" Bio Techniques 45: 659-668 (Dec. 2008).
Ullman et al., "Adenovirus E4 ORF3 Protein Inhibits the Interferon-Mediated Antiviral Response", Journal of Virology, 2007, 81(9):4744-4752.
Verheije et al., "Retargeting of Viruses to Generate Oncolytic Agents," Adv. Virol., vol. 2012:1-15,2012.
Volk et al., "Enhanced Adenovirus Infection of Melanoma Cells by Fiber-Modification," Cancer Biol Ther., vol. 2(5): 511-515, 2003.
Waehler et al., "Engineering targeted viral vectors for gene therapy," Nat Rev Genet., vol. 8(8):573-587, 2007.
Wang et al., "Identification of Specific Adenovirus E1A-N-Terminal Residues Critical to the Binding of Cellular Proteins and to the Control of Cell Growth," J. Virol., vol. 67:476-488, 1993.
Warram et al., "A Genetic Strategy for Combined Screening and Localized Imaging of Breast Cancer," Mol Imaging Biol., vol. 13:452-461, 2011.
Whyte et al., "Association between an Oncogene and an Anti-Oncogene: the Adenovirus E1A Proteins Bind to the Retinoblastoma Gene Product," Nature, vol. 334:124-129, 1988.
Yaghoubi et al., "Positron Emission Tomography Reporter Genes and Reporter Probes: Gene and Cell Therapy Applications," Theranostics, vol. 2:374-391, 2012.
Yount et al., "Strategy for Systematic Assembly of Large RNA and DNA Genomes: Transmissible Gastroenteritis Virus Model," J. Virol., vol. 74: 10600- 10611, 2000.

* cited by examiner

FIG. 2
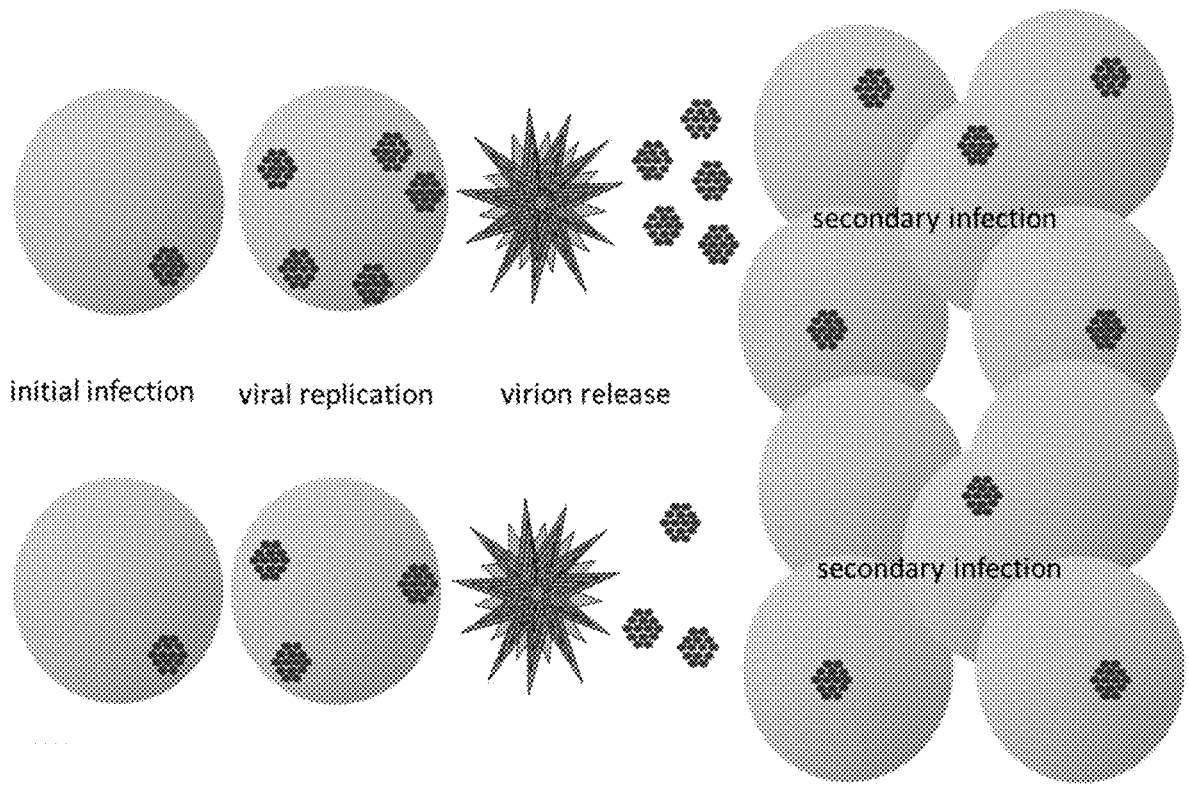
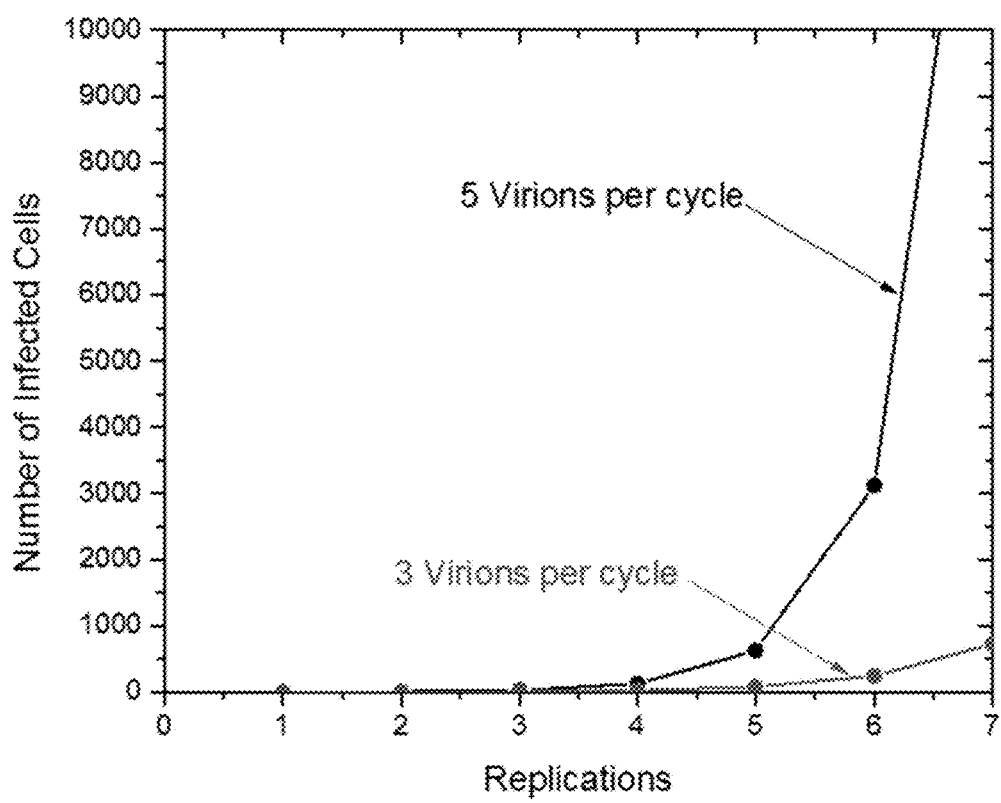

FIG. 4A

Date: 140509
48 WELL PLATE NO: 2
Upper Half

Ratio of Xtreme Gene to DNA (ul : ug): 2
Dilution factor for Xtreme Gene to media: 0.03

| | 1 | 2 | 3 | 4 | 5 | 6 | 7 | 8 |
|---|---|---|---|---|---|---|---|---|
| | 500ng of CMBT-352 for 4 hours | 500ng of PCMN-389 for 4 hours | 500ng of CMBT-379 for 4 hours | 500ng of PCMN-422 for 4 hours | 500ng of CMBT-432 for 4 hours | 500ng of CMBT-403 for 4 hours | Mock | BLANK |
| Source DNA concentration (ng/ul): | 77.0 | 107.0 | 138.0 | 110.0 | 165.0 | 94.0 | 0.0 | N/A |
| Mass of DNA per tube A (ng): | 2000.0 | 2000.0 | 2000.0 | 2000.0 | 2000.0 | 2000.0 | 2000.0 | N/A |
| Volume of DMEM + 0% FBS per tube A (ul): | 133.3 | 133.3 | 133.3 | 133.3 | 133.3 | 133.3 | 133.3 | N/A |
| Volume of Xtreme Gene solution per tube A (ul): | 4.0 | 4.0 | 4.0 | 4.0 | 4.0 | 4.0 | 4.0 | N/A |
| Volume of DNA per tube A (ul): | 26.0 | 18.7 | 14.5 | 18.2 | 12.1 | 21.3 | 26.0 | N/A |
| Concentration of DNA in tube A (ng/ul): | 12.2 | 12.8 | 13.2 | 12.9 | 13.4 | 12.6 | 12.2 | N/A |
| Total volume in tube A (ul): | 163.3 | 156.0 | 151.8 | 155.5 | 149.5 | 158.6 | 163.3 | N/A |
| | | | Vortex | | | | | |
| | | Incubate at room temperature for 15-30 minutes | | | | | | |
| Volume of DMEM + 2% FBS per tube B (ul): | 557.1 | 563.5 | 567.2 | 563.9 | 569.2 | 561.2 | 557.1 | N/A |
| Volume of tube A added to tube B (ul): | 142.9 | 136.5 | 132.8 | 136.1 | 130.8 | 138.8 | 142.9 | N/A |
| Effective Percentage FBS: | 1.59 | 1.61 | 1.62 | 1.61 | 1.63 | 1.60 | 1.59 | N/A |
| Total volume in tube B (ul): | 700.0 | 700.0 | 700.0 | 700.0 | 700.0 | 700.0 | 700.0 | N/A |
| | | | Vortex | | | | | |
| Total DNA needed (ng): | 1750.0 | 1750.0 | 1750.0 | 1750.0 | 1750.0 | 1750.0 | 0.0 | N/A |
| Mass of DNA per well (ng): | 500.0 | 500.0 | 500.0 | 500.0 | 500.0 | 500.0 | 0.0 | N/A |
| Volume per well (ul): | 200.0 | 200.0 | 200.0 | 200.0 | 200.0 | 200.0 | 200.0 | N/A |

| | 1 | 2 | 3 | 4 | 5 | 6 | 7 | 8 |
|---|---|---|---|---|---|---|---|---|
| A | 1300 | 1300 | 1300 | 1300 | 1300 | 1300 | 1300 | 0 |
| B | 1300 | 1300 | 1300 | 1300 | 1300 | 1300 | 1300 | 0 |
| C | 1300 | 1300 | 1300 | 1300 | 1300 | 1300 | 1300 | 0 |

Total volume in wells (ul):
(Media after trans: DMEM + 10% FBS)

FIG. 4B

Date: 140509
48 WELL PLATE NO: 2
Lower Half

Ratio of Xtreme Gene to DNA (ul : ug): 2
Dilution factor for Xtreme Gene to media: 0.03

| | 1 | 2 | 3 | 4 | 5 | 6 | 7 | 8 |
|---|---|---|---|---|---|---|---|---|
| | 500ng of PCMN-421 for 4 hours | 500ng of CMBT-429 for 4 hours | 500ng of CMBT-428 for 4 hours | 500ng of CMBT-407 for 4 hours | 500ng of CMBT-426 for 4 hours | 500ng of CMBT-427 for 4 hours | 500ng of CMBT-424 for 4 hours | 500ng of CMBT-425 for 4 hours |
| Source DNA concentration (ng/ul): | 106.0 | 188.0 | 114.0 | 105.0 | 104.0 | 101.0 | 103.0 | 187.0 |
| Mass of DNA per tube A (ng): | 2000.0 | 2000.0 | 2000.0 | 2000.0 | 2000.0 | 2000.0 | 2000.0 | 2000.0 |
| Volume of DMEM + 0% FBS per tube A (ul): | 133.3 | 133.3 | 133.3 | 133.3 | 133.3 | 133.3 | 133.3 | 133.3 |
| Volume of Xtreme Gene solution per tube A (ul): | 4.0 | 4.0 | 4.0 | 4.0 | 4.0 | 4.0 | 4.0 | 4.0 |
| Volume of DNA per tube A (ul): | 18.9 | 10.6 | 17.5 | 19.0 | 19.2 | 19.8 | 19.4 | 10.7 |
| Concentration of DNA in tube A (ng/ul): | 12.8 | 13.5 | 12.9 | 12.8 | 12.8 | 12.7 | 12.8 | 13.5 |
| Total volume in tube A (ul): | 156.2 | 148.0 | 154.9 | 156.4 | 156.6 | 157.1 | 156.8 | 148.0 |
| | | | | Vortex | | | | |
| | | | Incubate at room temperature for 15-30 minutes | | | | | |
| Volume of DMEM + 2% FBS per tube B (ul): | 563.3 | 570.5 | 564.5 | 563.2 | 563.0 | 562.5 | 562.8 | 570.5 |
| Volume of tube A added to tube B (ul): | 136.7 | 129.5 | 135.5 | 136.8 | 137.0 | 137.5 | 137.2 | 129.5 |
| Effective Percentage FBS: | 1.61 | 1.63 | 1.61 | 1.61 | 1.61 | 1.61 | 1.61 | 1.63 |
| Total volume in tube B (ul): | 700.0 | 700.0 | 700.0 | 700.0 | 700.0 | 700.0 | 700.0 | 700.0 |
| | | | | Vortex | | | | |
| Total DNA needed (ng): | 1750.0 | 1750.0 | 1750.0 | 1750.0 | 1750.0 | 1750.0 | 1750.0 | 1750.0 |
| Mass of DNA per well (ng): | 500.0 | 500.0 | 500.0 | 500.0 | 500.0 | 500.0 | 500.0 | 500.0 |
| Volume per well (ul): | 200.0 | 200.0 | 200.0 | 200.0 | 200.0 | 200.0 | 200.0 | 200.0 |

| | 1 | 2 | 3 | 4 | 5 | 6 | 7 | 8 |
|---|---|---|---|---|---|---|---|---|
| D | 1300 | 1300 | 1300 | 1300 | 1300 | 1300 | 1300 | 1300 |
| E | 1300 | 1300 | 1300 | 1300 | 1300 | 1300 | 1300 | 1300 |
| F | 1300 | 1300 | 1300 | 1300 | 1300 | 1300 | 1300 | 1300 |

Total volume in wells (ul):
(Media after trans: DMEM + 10%FBS)

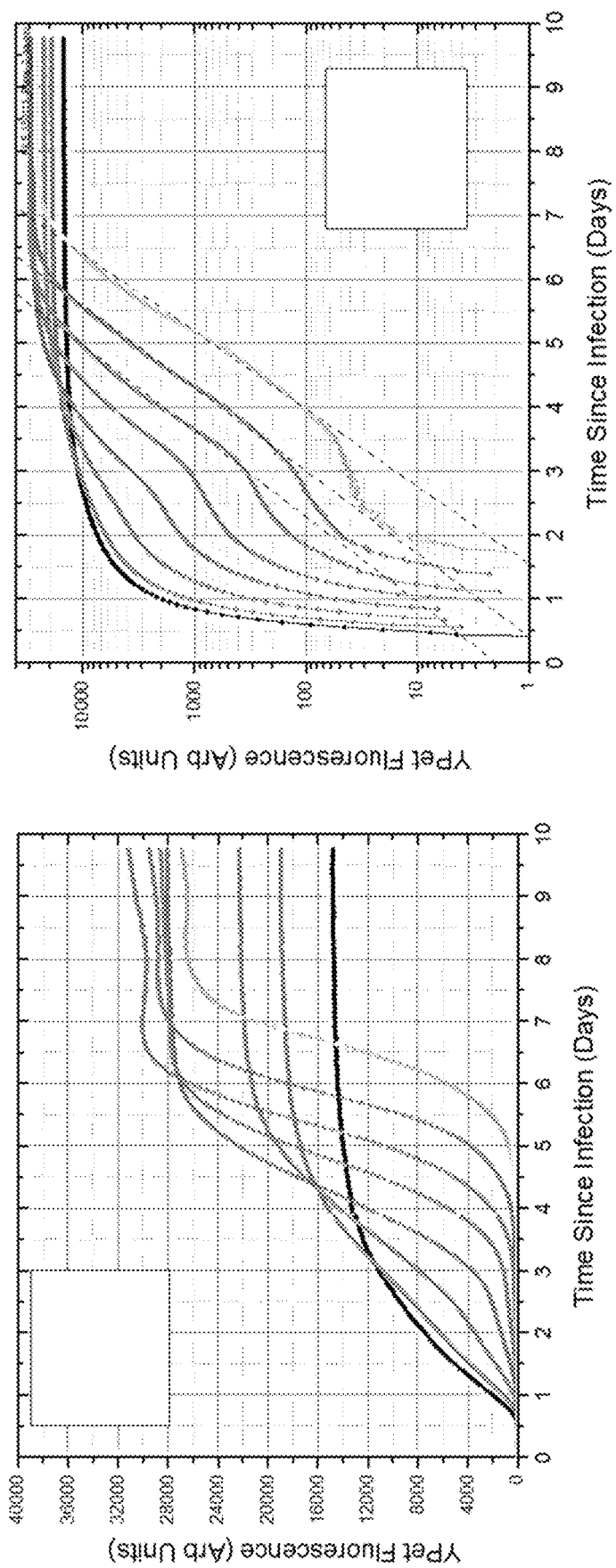
FIG. 8  Kinetics Data Analysis and Interpretation
- Fluorescence measured over multiple viral replication cycles
- Semi-log graph provides ln-slope
  - Similar analysis to yeast or bacteria growth curves
- Kinetics across viruses and cell lines can be compared
$$F(t) = Ae^{\alpha(t-t_0)} \implies \ln[F(t)] = \ln(A) + \alpha t - \alpha t_0$$

HIGH THROUGHPUT ASSAY FOR MEASURING ADENOVIRUS REPLICATION KINETICS

CROSS REFERENCE TO RELATED APPLICATIONS

This application is a continuation of PCT International Application No. PCT/US2017/019082, filed Feb. 23, 2017, published in English under PCT Article 21(2), which claims the benefit of U.S. Provisional Application No. 62/298,649, filed Feb. 23, 2016. The above-referenced applications are herein incorporated by reference in their entirety.

FIELD

This disclosure concerns the optimal placement of exogenous open reading frames in recombinant adenovirus constructs and use of the recombinant viruses in assays for measuring adenovirus replication kinetics.

BACKGROUND

Adenovirus serotype 5 (Ad5) is the vector of choice in basic research applications, murine lung cancer models, and human gene therapy trials. Adenoviruses have a stable 36 kb double-stranded DNA genome protected by a protein capsid decorated with Ad fiber protein spikes that target infection to receptors on specific cell types. Adenoviruses do not integrate into host DNA, can be produced to high titers using established protocols, and have proven safety in human gene therapy and cancer applications. Thus, Ad-based vectors have enormous promise for cancer diagnostics and therapies. However, a need exists for a rapid and high-throughput means of evaluating replication kinetics of recombinant adenoviruses designed for clinical and therapeutic use.

SUMMARY

Disclosed herein are recombinant adenovirus genomes that include a heterologous open reading frame (ORF) and a self-cleaving peptide coding sequence. The recombinant adenovirus genomes and recombinant adenoviruses produced by the disclosed genomes can be used, for example, in assays to measure virus replication kinetics.

Provided herein are recombinant adenovirus genomes that include a heterologous ORF and a self-cleaving peptide coding sequence, both operably linked to and in the same reading frame as an endogenous adenovirus ORF. The self-cleaving peptide coding sequence is located between the heterologous ORF and the endogenous ORF. In some embodiments, the endogenous ORF is E1B-55k and the heterologous ORF is 3' of E1B-55k; the endogenous ORF is DNA polymerase and the heterologous ORF is 5' of DNA polymerase; the endogenous ORF is DNA-binding protein (DBP) and the heterologous ORF is 3' of DBP; the endogenous ORF is adenovirus death protein (ADP) and the heterologous ORF is 5' of ADP; the endogenous ORF is E3-14.7k and the heterologous ORF is 3' of E3-14.7k; or the endogenous ORF is E4-ORF2 and the heterologous ORF is 5' of E4-ORF2.

Further provided herein are recombinant adenoviruses that include a recombinant adenovirus genome disclosed herein.

Also provided are methods for measuring replication kinetics of a recombinant adenovirus. In some embodiments, the genome of the recombinant adenovirus comprises a heterologous ORF encoding a fluorescent protein and a self-cleaving peptide coding sequence, both operably linked to and in the same reading frame as an endogenous adenovirus ORF selected from E1B-55k, DNA polymerase, DBP, ADP, E3-14.7k and E4-ORF2. The self-cleaving peptide coding sequence is located between the heterologous ORF and the endogenous adenovirus ORF. In some examples, the method includes transfecting cells with the genome of the recombinant adenovirus, or infecting cells with particles of the recombinant adenovirus; culturing the transfected cells or infected cells for at least two days; measuring fluorescence at regular intervals throughout the culture period; and calculating log-slope from the fluorescence measurements. The method can be used, for example, to select an appropriate therapeutic adenovirus (such as an oncolytic adenovirus) for treatment of a tumor by obtaining tumor cells (such as from a biopsy) and measuring replication kinetics in the tumor cells of a recombinant adenovirus that corresponds to the therapeutic adenovirus, except that a therapeutic ORF of the therapeutic adenovirus is replaced with an ORF encoding a fluorescent protein. Similarly, the method can be used to select cancer patients that would respond to treatment with a particular therapeutic adenovirus or to identify the most efficacious therapeutic adenovirus for a particular tumor.

The foregoing and other objects and features of the disclosure will become more apparent from the following detailed description, which proceeds with reference to the accompanying figures.

BRIEF DESCRIPTION OF THE DRAWINGS

FIG. 2 is a schematic showing exponential viral growth. Oncolytic killing of all cells within a tumor requires exponential viral growth. However, in most instances, only a small percentage of tumor cells are initially infected. Thus, a small difference in the number of progeny per round of replication leads to large differences in the total number of particles after just a few rounds of replication. Shown is a comparison between a virus that produces 3 virions per cycle and a virus that produces 5 virions per cycle. As shown in the graph, after 5-6 rounds of replication, viral titers of the two viruses are significantly different.

FIGS. 4A-4B outline an exemplary kinetic assay setup when starting with adenovirus genome plasmids. This assay does not require knowledge of initial transfection efficiency. Transfection conditions are selected to result in approximately 5-10% of cells initially transfected. In the example shown, a 48-well plate is used, which allows for the testing of 14 different virus constructs in triplicate, along with three mock-infected wells and three wells with FLUO-RESBRITE™ beads to compensate for tool sensitivity drift. (FIG. 4A) The wells of the upper half of the 48-well plate contain cells transfected with the genome plasmids of 6 different viruses, mock-infected cells, and blanks (FLUO-RESBRITE™ beads), each in triplicate. (FIG. 4B) The wells of the lower half of the 48-well plate contain cells transfected with the genome plasmids of 8 different viruses in triplicate. The multi-well plate is placed on a plate reader (such as a TECAN plate reader) for continuous fluorescence monitoring.

(FIG. 6A) The adenovirus genome is separated into four modules—E1, core, E3 and E4. (FIG. 6B) Adsembly involves genome reassembly using multi-site Gateway reactions. (FIG. 6C) AdSLIC utilizes sequence and ligation independent cloning (SLIC) to assemble adenovirus modules.

FIG. 8 is a schematic of kinetic data analysis and interpretation for the fluorescence-based viral kinetic assay.

SEQUENCE LISTING

Figure 1:
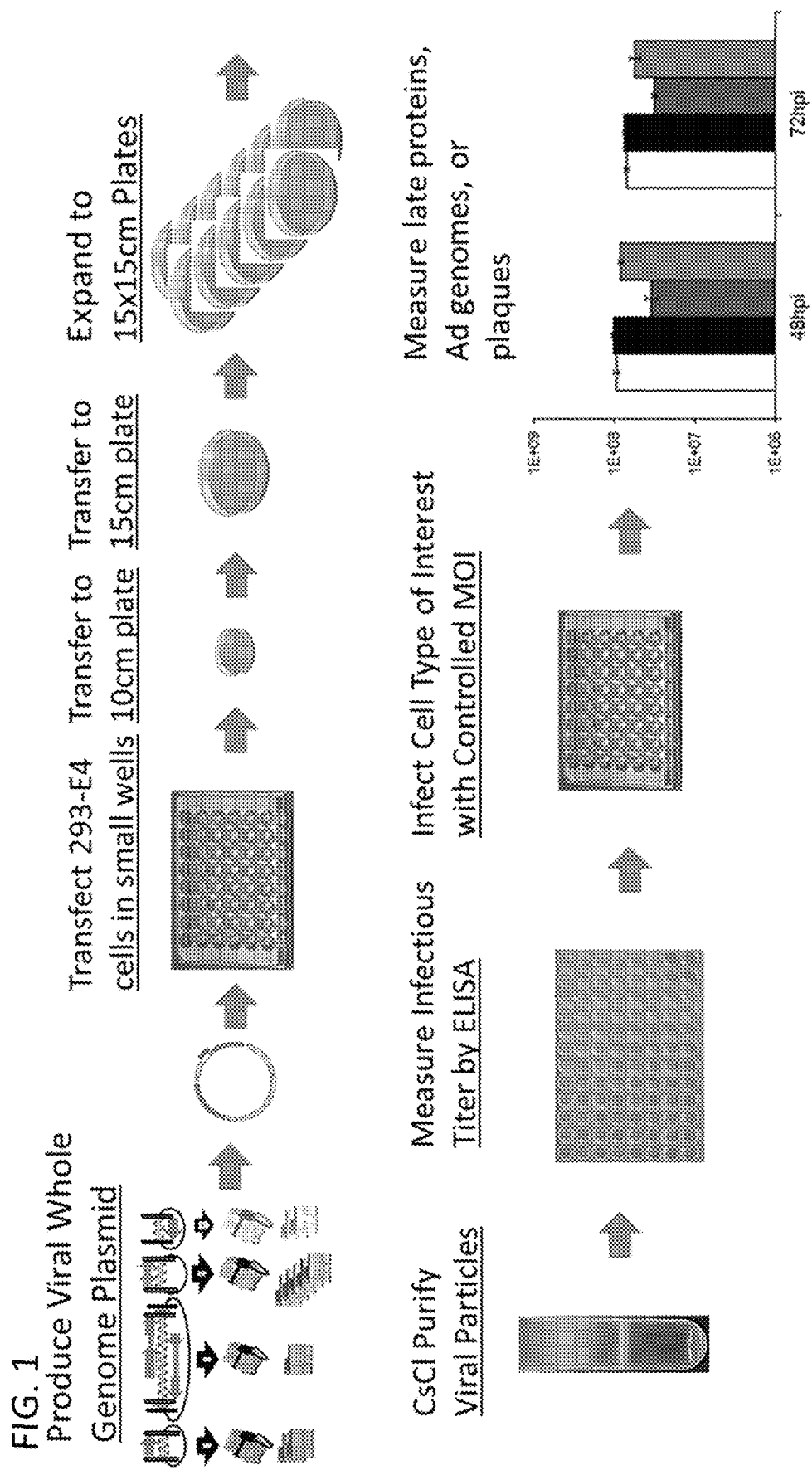
FIG. 1 is a schematic of an exemplary work-flow for testing adenoviral constructs. Whole virus genome plasmid is produced and transfected into suitable cells, such as 293-E4 cells, in a multi-well plate. As transfected cells expand, they are subjected to freeze/thaw to release viral particles, followed by centrifugation to pellet cell debris. The supernatant (containing the viral particles) is transferred to multiple, larger culture plates. Viral particles are harvested from transfected cells, CsCl purified and infectious virus titer is measured by ELISA. The cell type of interest is then infected with a known MOI of purified virus. At 48 or 72 hours post-infection, adenovirus late proteins, adenovirus genomes or plaques are measured by Western blot, q-PCR or plaque assay, respectively.

The nucleic and amino acid sequences listed in the accompanying sequence listing are shown using standard letter abbreviations for nucleotide bases, and three letter code for amino acids, as defined in 37 C.F.R. 1.822. Only one strand of each nucleic acid sequence is shown, but the complementary strand is understood as included by any reference to the displayed strand. The Sequence Listing is submitted as an ASCII text file, created on Jul. 18, 2018, 609 KB, which is incorporated by reference herein. In the accompanying sequence listing:

SEQ ID NO: 1 is the nucleotide sequence of synthetic adenovirus genome CMBT-379 (YPet-P2A-E1A).

SEQ ID NO: 2 is the nucleotide sequence of synthetic adenovirus genome CMBT-432 (E1A-P2A-YPet).

SEQ ID NO: 3 is the nucleotide sequence of synthetic adenovirus genome CMBT-456 (E1B-55k-P2A-YPet).

SEQ ID NO: 4 is the nucleotide sequence of synthetic adenovirus genome CMBT-499 (E1B-55k-P2A-mCherry).

SEQ ID NO: 5 is the nucleotide sequence of synthetic adenovirus genome CMBT-530 (YPet-P2A-(DNA Poly)).

SEQ ID NO: 6 is the nucleotide sequence of synthetic adenovirus genome CMBT-886 (DBP-P2A-YPet).

SEQ ID NO: 7 is the nucleotide sequence of synthetic adenovirus genome CMBT-403 (YPet-P2A-ADP).

SEQ ID NO: 8 is the nucleotide sequence of synthetic adenovirus genome CMBT-429 (ADP-P2A-YPet).

SEQ ID NO: 9 is the nucleotide sequence of synthetic adenovirus genome PCMN-887 (E3-14.7k-P2A-YPet).

SEQ ID NO: 10 is the nucleotide sequence of synthetic adenovirus genome CMBT-457 (YPet-P2A-E4-ORF2).

SEQ ID NO: 11 is the nucleotide sequence of synthetic adenovirus genome CMBT-633 (mCherry-P2A-E4-ORF2).

SEQ ID NO: 12 is the amino acid sequence of P2A.

SEQ ID NO: 13 is the amino acid sequence of F2A.

SEQ ID NO: 14 is the amino acid sequence of E2A.

SEQ ID NO: 15 is the amino acid sequence of T2A.

SEQ ID NO: 16 is the amino acid sequence of a modified P2A comprising GSG at the N-terminus.

SEQ ID NO: 17 is the amino acid sequence of a modified F2A comprising GSG at the N-terminus.

SEQ ID NO: 18 is the amino acid sequence of a modified E2A comprising GSG at the N-terminus.

SEQ ID NO: 19 is the amino acid sequence of a modified T2A comprising GSG at the N-terminus.

SEQ ID NO: 20 is the nucleotide sequence of synthetic adenovirus genome PCMN-888 (Ad9 E3-15k-P2A-YPet).

SEQ ID NO: 21 is the nucleotide sequence of synthetic adenovirus genome PCMN-889 (Ad34 E3-14.8k-P2A-YPet).

DETAILED DESCRIPTION

I. Abbreviations

Ad adenovirus
ADP adenovirus death protein
BFP blue fluorescent protein
DBP DNA-binding protein
E2A equine rhinitis A virus 2A
ELISA enzyme-linked immunosorbent assay
ERAV equine rhinitis A virus
F2A foot and mouth disease virus 2A
FACS fluorescence activated cells sorting
FMDV food and mouth disease virus
GFP green fluorescent protein
MOI multiplicity of infection
OD optical density
ORF open reading frame
P2A porcine teschovirus-1 2A
pIX protein IX
PTV1 porcine teschovirus-1

RFP red fluorescent protein
SLIC sequence and ligation independent cloning
T2A Thosea asigna virus 2A
TaV Thosea asigna virus
YFP yellow fluorescent protein II. Terms and Methods Unless otherwise noted, technical terms are used according to conventional usage. Definitions of common terms in molecular biology may be found in Benjamin Lewin, *Genes V*, published by Oxford University Press, 1994 (ISBN 0-19-854287-9); Kendrew et al. (eds.), *The Encyclopedia of Molecular Biology*, published by Blackwell Science Ltd., 1994 (ISBN 0-632-02182-9); and Robert A. Meyers (ed.), *Molecular Biology and Biotechnology: a Comprehensive Desk Reference*, published by VCH Publishers, Inc., 1995 (ISBN 1-56081-569-8).

In order to facilitate review of the various embodiments of the disclosure, the following explanations of specific terms are provided:

2A peptide: A type of self-cleaving peptide encoded by some RNA viruses, such as picornaviruses. 2A peptides function by making the ribosome skip the synthesis of a peptide bond at the C-terminus of a 2A element, leading to separation between the end of the 2A sequence and the downstream peptide (Kim et al., *PLoS One* 6(4):e18556, 2011). The "cleavage" occurs between the glycine and proline residues found on the C-terminus of the 2A peptide. Exemplary 2A peptides include, but are not limited to, the 2A peptides encoded by Thosea asigna virus (TaV), equine rhinitis A virus (ERAV), porcine teschovirus-1 (PTV1) and foot and mouth disease virus (FMDV), which are set forth herein as SEQ ID NOs: 12-15. In some embodiments, the 2A peptide comprises Gly-Ser-Gly at the N-terminus to improve cleavage efficiency (SEQ ID NOs: 16-19).

Adenovirus: A non-enveloped virus with a linear, double-stranded DNA genome and an icosahedral capsid. There are currently 68 known serotypes of human adenovirus, which are divided into seven species (species A, B, C, D, E, F and G). Different serotypes of adenovirus are associated with different types of disease, with some serotypes causing respiratory disease (primarily species B and C), conjunctivitis (species B and D) and/or gastroenteritis (species F and G).

Adenovirus death protein (ADP): A protein synthesized in the late stages of adenovirus infection that mediates lysis of cells and release of adenovirus to infect other cells. ADP is an integral membrane glycoprotein of 101 amino acids that localizes to the nuclear membrane, endoplasmic reticulum and Golgi. ADP was previously named E3-11.6K).

Chimeric: Composed of at least two parts having different origins. In the context of the present disclosure, a "chimeric adenovirus" is an adenovirus having genetic material and/or proteins derived from at least two different serotypes (such as from Ad5 and a second serotype of adenovirus). In this context, a "capsid-swapped" adenovirus refers to a chimeric adenovirus in which the capsid proteins are derived from one serotype of adenovirus and the remaining proteins are derived from another adenovirus serotype. Similarly, a "chimeric fiber" is a fiber protein having amino acid sequence derived from at least two different serotypes of adenovirus. For example, a chimeric fiber can be composed of a fiber shaft from Ad5 and a fiber knob from a second serotype of adenovirus. In another example, a chimeric fiber is composed of an Ad5 tail and a fiber shaft and knob from a second serotype of adenovirus (such as Ad9 or Ad34).

Contacting: Placement in direct physical association; includes both in solid and liquid form.

Degenerate variant: In the context of the present disclosure, a "degenerate variant" refers to a polynucleotide encoding a peptide that includes a sequence that is degenerate as a result of the genetic code. There are 20 natural amino acids, most of which are specified by more than one codon. Therefore, all degenerate nucleotide sequences encoding a peptide are included as long as the amino acid sequence of the peptide encoded by the nucleotide sequence is unchanged.

Deleted: An adenovirus genome encoding a "deleted" protein (such as the E4orf1 or E4orf6/7 protein) refers to an adenovirus having a complete deletion of the protein coding sequence, or a partial deletion that results in the absence of protein expression.

Deregulation of E2F: Refers to an increase in activity of the E2F transcription factor and downstream target genes, which occurs in nearly all types of human cancer. Deregulation of the E2F pathway activity and transcription can result from a variety of different mutations in any upstream component of the pathway, such as loss of function mutations and deletions in Rb, p107 and p130 tumor suppressors. Rb was the first tumor suppressor to be identified and is absent or mutated in at least one third of human tumors. In addition, p16 mutations and/or epigenetic silencing can activate E2F in tumor cells. Cyclin D and CDK4 mutations, gene amplifications or over-expression can also result in deregulated E2F activity in human tumors. In addition E2F is activated by growth factor receptor pathway mutations including EGFR, RTKs, RAS, RAF, PI-3K, PTEN, RAF, MYC. Mutations in the $p16^{INK4a}$-Cyclin D:cdk4/6-RB-E2F pathway generally occur in a mutually exclusive fashion, so that one 'hit' (for example, p16) is unaccompanied by others (for example, Rb mutation or cyclin D:cdk over-expression). However, most current chemotherapies are proliferative poisons that inhibit E2F transcriptional targets, but are also toxic to normal cells and have often devastating iatrogenic complications. As disclosed herein, an alternative therapeutic approach is to use a virus that undergoes selective lytic replication in cancer cell lesions that have deregulated the p16-cyclin D:cdk4-RB-E2F pathway.

DNA-binding protein (DBP): This adenovirus protein binds to single-stranded DNA and RNA, as well as double-stranded DNA. DBP, a 72-kilodalton protein, is essential for replication of adenoviral DNA.

E1A: The adenovirus early region 1A (E1A) gene and polypeptides expressed from the gene. The E1A protein plays a role in viral genome replication by driving cells into the cell cycle. As used herein, the term "E1A protein" refers to the proteins expressed from the E1A gene and the term includes E1A proteins produced by any adenovirus serotype.

E3-RIDα/RIDβ and E3-14.7k: Early-expressed proteins produced from the E3 gene. The E3-RIDα, E3-RIDβ, and E3-14.7k proteins make up the receptor internalization and degradation complex (RID), which localizes to the nuclear membrane and causes the endocytosis and degradation of a variety of receptors including CD95 (FasL receptor), and TNFR1 and 2 (TNF/TRAIL receptors) to protect infected cells from host antiviral responses. The E3-RIDα, E3-RIDβ, and E3-14.7k coding sequences are next to each other, in this order.

E4orf1: An adenovirus protein produced from the E4 gene. The term "E4orf1 protein" includes E4orf1 proteins produced by the E4 gene from any adenovirus serotype.

E4orf6/7: A protein encoded by the adenovirus E4 gene. The term "E4orf6/7 protein" includes E4orf6/7 proteins produced by the E4 gene from any adenovirus serotype.

Fluorescent protein: A protein that emits light of a certain wavelength when exposed to a particular wavelength of light. Fluorescent proteins include, but are not limited to, green fluorescent proteins (such as GFP, EGFP, AcGFP1, Emerald, Superfolder GFP, Azami Green, mWasabi, TagGFP, TurboGFP and ZsGreen), blue fluorescent proteins (such as EBFP, EBFP2, Sapphire, T-Sapphire, Azurite and mTagBFP), cyan fluorescent proteins (such as ECFP, mECFP, Cerulean, CyPet, AmCyan1, Midori-Ishi Cyan, mTurquoise and mTFP1), yellow fluorescent proteins (EYFP, Topaz, Venus, mCitrine, YPet, TagYFP, PhiYFP, ZsYellow1 and mBanana), orange fluorescent proteins (Kusabira Orange, Kusabira Orange2, mOrange, mOrange2 and mTangerine), red fluorescent proteins (mRuby, mApple, mStrawberry, AsRed2, mRFP1, JRed, mCherry, HcRed1, mRaspberry, dKeima-Tandem, HcRed-Tandem, mPlum, AQ143, tdTomato and E2-Crimson), orange/red fluorescence proteins (dTomato, dTomato-Tandem, TagRFP, TagRFP-T, DsRed, DsRed2, DsRed-Express (T1) and DsRed-Monomer) and modified versions thereof.

Fusion protein: A protein containing amino acid sequence from at least two different (heterologous) proteins or peptides. Fusion proteins can be generated, for example, by expression of a nucleic acid sequence engineered from nucleic acid sequences encoding at least a portion of two different (heterologous) proteins. To create a fusion protein, the nucleic acid sequences must be in the same reading frame and contain no internal stop codons. Fusion proteins, particularly short fusion proteins, can also be generated by chemical synthesis.

Heterologous: A heterologous protein or polypeptide refers to a protein or polypeptide derived from a different source or species.

Hexon: A major adenovirus capsid protein.

Isolated: An "isolated" biological component (such as a nucleic acid molecule, protein, virus or cell) has been substantially separated or purified away from other biological components in the cell or tissue of the organism, or the organism itself, in which the component naturally occurs, such as other chromosomal and extra-chromosomal DNA and RNA, proteins and cells. Nucleic acid molecules and proteins that have been "isolated" include those purified by standard purification methods. The term also embraces nucleic acid molecules and proteins prepared by recombinant expression in a host cell as well as chemically synthesized nucleic acid molecules and proteins.

Modification: A change in the sequence of a nucleic acid or protein sequence. For example, amino acid sequence modifications include, for example, substitutions, insertions and deletions, or combinations thereof. Insertions include amino and/or carboxyl terminal fusions as well as intrasequence insertions of single or multiple amino acid residues. Deletions are characterized by the removal of one or more amino acid residues from the protein sequence. In some embodiments herein, the modification (such as a substitution, insertion or deletion) results in a change in function, such as a reduction or enhancement of a particular activity of a protein. As used herein, "Δ" or "delta" refer to a deletion. Substitutional modifications are those in which at least one residue has been removed and a different residue inserted in its place. Amino acid substitutions are typically of single residues, but can occur at a number of different locations at once. Substitutions, deletions, insertions or any combination thereof may be combined to arrive at a final mutant sequence. These modifications can be prepared by modification of nucleotides in the DNA encoding the protein, thereby producing DNA encoding the modification. Techniques for making insertion, deletion and substitution mutations at predetermined sites in DNA having a known sequence are well known in the art. A "modified" protein, nucleic acid or virus is one that has one or more modifications as outlined above.

Neoplasia, malignancy, cancer and tumor: A neoplasm is an abnormal growth of tissue or cells that results from excessive cell division. Neoplastic growth can produce a tumor. The amount of a tumor in an individual is the "tumor burden" which can be measured as the number, volume, or weight of the tumor. A tumor that does not metastasize is referred to as "benign." A tumor that invades the surrounding tissue and/or can metastasize is referred to as "malignant." Malignant tumors are also referred to as "cancer."

Hematologic cancers are cancers of the blood or bone marrow. Examples of hematological (or hematogenous) cancers include leukemias, including acute leukemias (such as acute lymphocytic leukemia, acute myelocytic leukemia, acute myelogenous leukemia and myeloblastic, promyelocytic, myelomonocytic, monocytic and erythroleukemia), chronic leukemias (such as chronic myelocytic (granulocytic) leukemia, chronic myelogenous leukemia, and chronic lymphocytic leukemia), polycythemia vera, lymphoma, Hodgkin's disease, non-Hodgkin's lymphoma (indolent and high grade forms), multiple myeloma, Waldenstrom's macroglobulinemia, heavy chain disease, myelodysplastic syndrome, hairy cell leukemia and myelodysplasia. In some cases, lymphomas are considered solid tumors.

Solid tumors are abnormal masses of tissue that usually do not contain cysts or liquid areas. Solid tumors can be benign or malignant. Different types of solid tumors are named for the type of cells that form them (such as sarcomas, carcinomas, and lymphomas). Examples of solid tumors, such as sarcomas and carcinomas, include fibrosarcoma, myxosarcoma, liposarcoma, chondrosarcoma, osteosarcoma, and other sarcomas, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, human papilloma virus (HPV)-infected neoplasias, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, seminoma, bladder carcinoma, melanoma, and CNS tumors (such as a glioma (such as brainstem glioma and mixed gliomas), glioblastoma (also known as glioblastoma multiforme) astrocytoma, CNS lymphoma, germinoma, medulloblastoma, Schwannoma craniopharyogioma, ependymoma, pinealoma, hemangioblastoma, acoustic neuroma, oligodendroglioma, menangioma, neuroblastoma, retinoblastoma and brain metastasis).

Oncolytic virus: A virus that selectively kills cells of a proliferative disorder, e.g., cancer/tumor cells. Killing of the cancer cells can be detected by any method, such as determining viable cell count, or detecting cytopathic effect, apoptosis, or synthesis of viral proteins in the cancer cells (e.g., by metabolic labeling, immunoblot, or RT-PCR of viral genes necessary for replication), or reduction in size of a tumor.

Operably linked: A first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Generally, operably linked DNA sequences are contiguous and, where necessary to join two protein-coding regions, in the same reading frame.

Polypeptide, peptide or protein: A polymer in which the monomers are amino acid residues which are joined together through amide bonds. When the amino acids are alpha-amino acids, either the L-optical isomer or the D-optical isomer can be used. The terms "polypeptide," "peptide" and "protein" are used interchangeably herein. These terms apply to amino acid polymers in which one or more amino acid residue is an artificial chemical mimetic of a corresponding naturally occurring amino acid, as well as to naturally occurring amino acid polymers and non-naturally occurring amino acid polymers. The term "residue" or "amino acid residue" includes reference to an amino acid that is incorporated into a protein, polypeptide, or peptide.

A conservative substitution in a polypeptide is a substitution of one amino acid residue in a protein sequence for a different amino acid residue having similar biochemical properties. Typically, conservative substitutions have little to no impact on the activity of a resulting polypeptide. For example, a protein or peptide including one or more conservative substitutions (for example no more than 1, 2, 3, 4 or 5 substitutions) retains the structure and function of the wild-type protein or peptide. A polypeptide can be produced to contain one or more conservative substitutions by manipulating the nucleotide sequence that encodes that polypeptide using, for example, standard procedures such as site-directed mutagenesis or PCR. In one example, such variants can be readily selected by testing antibody cross-reactivity or its ability to induce an immune response. Examples of conservative substitutions are shown below.

| Original Residue | Conservative Substitutions |
| --- | --- |
| Ala | Ser |
| Arg | Lys |
| Asn | Gln, His |
| Asp | Glu |
| Cys | Ser |
| Gln | Asn |
| Glu | Asp |
| His | Asn; Gln |
| Ile | Leu, Val |
| Leu | Ile; Val |
| Lys | Arg; Gln; Glu |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

Conservative substitutions generally maintain (a) the structure of the polypeptide backbone in the area of the substitution, for example, as a sheet or helical conformation, (b) the charge or hydrophobicity of the molecule at the target site, or (c) the bulk of the side chain.

The substitutions which in general are expected to produce the greatest changes in protein properties will be non-conservative, for instance changes in which (a) a hydrophilic residue, for example, seryl or threonyl, is substituted for (or by) a hydrophobic residue, for example, leucyl, isoleucyl, phenylalanyl, valyl or alanyl; (b) a cysteine or proline is substituted for (or by) any other residue; (c) a residue having an electropositive side chain, for example, lysyl, arginyl, or histadyl, is substituted for (or by) an electronegative residue, for example, glutamyl or aspartyl; or (d) a residue having a bulky side chain, for example, phenylalanine, is substituted for (or by) one not having a side chain, for example, glycine.

Promoter: A region of DNA that directs/initiates transcription of a nucleic acid (e.g. a gene). A promoter includes necessary nucleic acid sequences near the start site of transcription. Typically, promoters are located near the genes they transcribe. A promoter also optionally includes distal enhancer or repressor elements which can be located as much as several thousand base pairs from the start site of transcription. A "constitutive promoter" is a promoter that is continuously active and is not subject to regulation by external signals or molecules. In contrast, the activity of an "inducible promoter" is regulated by an external signal or molecule (for example, a transcription factor or tetracycline).

Protein IX (pIX): A minor component of the adenovirus capsid that associates with the hexon protein.

Purified: The term "purified" does not require absolute purity; rather, it is intended as a relative term. Thus, for example, a purified peptide, protein, virus, or other active compound is one that is isolated in whole or in part from naturally associated proteins and other contaminants. In certain embodiments, the term "substantially purified" refers to a peptide, protein, virus or other active compound that has been isolated from a cell, cell culture medium, or other crude preparation and subjected to fractionation to remove various components of the initial preparation, such as proteins, cellular debris, and other components.

Recombinant: A recombinant nucleic acid molecule, protein or virus is one that has a sequence that is not naturally occurring or has a sequence that is made by an artificial combination of two otherwise separated segments of sequence. This artificial combination can be accomplished by chemical synthesis or by the artificial manipulation of isolated segments of nucleic acid molecules, such as by genetic engineering techniques. The term "recombinant" also includes nucleic acids, proteins and viruses that have been altered solely by addition, substitution, or deletion of a portion of the natural nucleic acid molecule, protein or virus.

Replication defects: An adenovirus that exhibits "replication defects" in a non-tumor cell (compared to a tumor cell) refers to an adenovirus that exhibits reduced viral replication in normal cells compared to tumor cells. Replication defects are evidenced by, for example, a lack of viral late protein expression, a reduction in viral DNA synthesis, a reduced ability to induce E2F target genes (e.g. cyclin A and B), a reduced ability to elicit S phase entry and/or a reduced ability to induce cell killing in normal cells compared to tumor cells.

Replication deficient virus: A virus that preferentially inhibits cell proliferation, causes cell lysis, or induces apoptosis (collectively considered killing) in a predetermined cell population with a given phenotype (e.g., tumor cells with a deregulated E2F pathway). Such viruses are unable to or are limited in the ability to reduce or inhibit cell proliferation, cause cell lysis, induce apoptosis, or otherwise replicate in cells that do not have the predetermined cell phenotype (such as normal, non-tumor cells).

Self-cleaving peptides: Peptides that induce the ribosome to skip the synthesis of a peptide bond at the C-terminus, leading to separation of the peptide sequence and a downstream polypeptide. Virally encoded 2A peptides are a type of self-cleaving peptide. Virally encoded 2A peptides include, for example, 2A peptides from porcine teschovirus-1 (PTV1), foot and mouth disease virus (FMDV), equine rhinitis A virus (ERAV) and Thosea asigna virus (TaV).

Sequence identity: The identity or similarity between two or more nucleic acid sequences, or two or more amino acid sequences, is expressed in terms of the identity or similarity between the sequences. Sequence identity can be measured in terms of percentage identity; the higher the percentage, the more identical the sequences are. Sequence similarity can be measured in terms of percentage similarity (which takes into account conservative amino acid substitutions); the higher the percentage, the more similar the sequences are. Homologs or orthologs of nucleic acid or amino acid sequences possess a relatively high degree of sequence identity/similarity when aligned using standard methods. This homology is more significant when the orthologous proteins or cDNAs are derived from species which are more closely related (such as human and mouse sequences), compared to species more distantly related (such as human and *C. elegans* sequences).

Methods of alignment of sequences for comparison are well known in the art. Various programs and alignment algorithms are described in: Smith & Waterman, *Adv. Appl. Math.* 2:482, 1981; Needleman & Wunsch, *J. Mol. Biol.* 48:443, 1970; Pearson & Lipman, *Proc. Natl. Acad. Sci. USA* 85:2444, 1988; Higgins & Sharp, *Gene*, 73:237-44, 1988; Higgins & Sharp, *CABIOS* 5:151-3, 1989; Corpet et al., *Nuc. Acids Res.* 16:10881-90, 1988; Huang et al. *Computer Appls. in the Biosciences* 8, 155-65, 1992; and Pearson et al., *Meth. Mol. Bio.* 24:307-31, 1994. Altschul et al., *J. Mol. Biol.* 215:403-10, 1990, presents a detailed consideration of sequence alignment methods and homology calculations.

The NCBI Basic Local Alignment Search Tool (BLAST) (Altschul et al., *J. Mol. Biol.* 215:403-10, 1990) is available from several sources, including the National Center for Biological Information (NCBI) and on the internet, for use in connection with the sequence analysis programs blastp, blastn, blastx, tblastn and tblastx. Additional information can be found at the NCBI web site.

Serotype: A group of closely related microorganisms (such as viruses) distinguished by a characteristic set of antigens.

Subject: Living multi-cellular vertebrate organisms, a category that includes human and non-human mammals.

Synthetic: Produced by artificial means in a laboratory, for example a synthetic nucleic acid or protein can be chemically synthesized in a laboratory.

Uexon: An open reading frame located on the 1 strand (leftward transcription) between the early E3 region and the fiber gene (Tollefson et al., *J Virol* 81(23):12918-12926).

Unless otherwise explained, all technical and scientific terms used herein have the same meaning as commonly understood by one of ordinary skill in the art to which this disclosure belongs. The singular terms "a," "an," and "the" include plural referents unless context clearly indicates otherwise. "Comprising A or B" means including A, or B, or A and B. It is further to be understood that all base sizes or amino acid sizes, and all molecular weight or molecular mass values, given for nucleic acids or polypeptides are approximate, and are provided for description. Although methods and materials similar or equivalent to those described herein can be used in the practice or testing of the present disclosure, suitable methods and materials are described below. All publications, patent applications, patents, and other references mentioned herein are incorporated by reference in their entirety. In case of conflict, the present specification, including explanations of terms, will control. In addition, the materials, methods, and examples are illustrative only and not intended to be limiting.

III. Overview of Embodiments

Disclosed herein are recombinant adenovirus genomes that include a heterologous open reading frame (ORF) and a self-cleaving peptide coding sequence. The recombinant adenovirus genomes and recombinant adenoviruses produced by the disclosed genomes can be used, for example, in high-throughput assays to measure virus replication kinetics.

Provided herein are recombinant adenovirus genomes that include a heterologous ORF and a self-cleaving peptide coding sequence, both operably linked to and in the same reading frame as an endogenous adenovirus ORF. The self-cleaving peptide coding sequence is located between the heterologous ORF and the endogenous ORF. In some embodiments, the endogenous ORF is E1B-55k and the heterologous ORF is 3' of E1B-55k; the endogenous ORF is DNA polymerase and the heterologous ORF is 5' of DNA polymerase; the endogenous ORF is DNA-binding protein (DBP) and the heterologous ORF is 3' of DBP; the endogenous ORF is adenovirus death protein (ADP) and the heterologous ORF is 5' of ADP; the endogenous ORF is E3-14.7k and the heterologous ORF is 3' of E3-14.7k; or the endogenous ORF is E4-ORF2 and the heterologous ORF is 5' of E4-ORF2.

In some embodiments, the self-cleaving peptide is a 2A peptide or variant thereof. In some examples, the 2A peptide includes a porcine teschovirus-1 (PTV1) 2A (P2A) peptide, a foot and mouth disease virus (FMDV) 2A (F2A) peptide, an equine rhinitis A virus (ERAV) 2A (E2A) peptide or a Thosea asigna virus (TaV) 2A (T2A) peptide, or a variant thereof. In particular examples, the P2A peptide sequence is at least 80%, at least 85%, at least 90%, at least 95%, at least 96%, at least 97%, at least 98% or at least 99% identical to the amino acid sequence of SEQ ID NO: 12 or SEQ ID NO: 16. In some examples, the 2A peptide variant comprises additional amino acid sequence (such as GSG) at the N-terminus.

In particular examples, the F2A peptide sequence is at least 80%, at least 85%, at least 90%, at least 95%, at least 96%, at least 97%, at least 98% or at least 99% identical to the amino acid sequence of SEQ ID NO: 13 or SEQ ID NO: 17. In particular examples, the E2A peptide sequence is at least 80%, at least 85%, at least 90%, at least 95%, at least 96%, at least 97%, at least 98% or at least 99% identical to the amino acid sequence of SEQ ID NO: 14 or SEQ ID NO: 18. In particular examples, the T2A peptide sequence is at least 80%, at least 85%, at least 90%, at least 95%, at least 96%, at least 97%, at least 98% or at least 99% identical to the amino acid sequence of SEQ ID NO: 15 or SEQ ID NO: 19. In specific non-limiting examples, the self-cleaving peptide comprises or consists of the amino acid sequence of any one of SEQ ID NOs: 12-19.

In some embodiments, the heterologous ORF encodes a fluorescent protein, such as, but not limited to a green fluorescent protein (GFP) a yellow fluorescent protein (YFP), a red fluorescent protein (RFP) or a blue fluorescent protein (BFP). Exemplary fluorescent proteins are known in the art and include, but are not limited to, the following:

BFPs—EBFP, EBFP2, Sapphire, T-Sapphire, Azurite, mTagBFP;

Cyan fluorescent proteins—ECFP, mECFP, Cerulean, CyPet, AmCyan1, Midori-Ishi Cyan, mTurquoise, mTFP1;

GFPs—GFP, EGFP, AcGFP1, Emerald, Superfolder GFP, Azami Green, mWasabi, TagGFP, TurboGFP, ZsGreen;

YFPs—EYFP, Topaz, Venus, mCitrine, YPet, TagYFP, PhiYFP, ZsYellow1, mBanana; Orange fluorescent proteins—Kusabira Orange, Kusabira Orange2, mOrange, mOrange2, mTangerine;

Orange or Red fluorescent proteins—dTomato, dTomato-Tandem, TagRFP, TagRFP-T, DsRed, DsRed2, DsRed-Express (T1), DsRed-Monomer; and RFPs—mRuby, mApple, mStrawberry, AsRed2, mRFP1, JRed, mCherry, HcRed1, mRaspberry, dKeima-Tandem, HcRed-Tandem, mPlum, AQ143, tdTomato, E2-Crimson.

In specific non-limiting examples, the YFP is YPet or the RFP is mCherry.

In some embodiments, the recombinant adenovirus genome includes, in the 5' to 3' direction: E1B-55K-P2A-YPet; E1B-55K-P2A-mCherry; YPet-P2A-(DNA polymerase); DBP-P2A-YPet; YPet-P2A-ADP; E3-14.7k-P2A-YPet; YPet-P2A-E4-ORF2; or mCherry-P2A-E4-ORF2. In some examples, the nucleotide sequence of the recombinant adenovirus genome is at least 80%, at least 85%, at least 90%, at least 95%, at least 96%, at least 97%, at least 98% or at least 99% identical to any one of SEQ ID NOs: 3-7, 9-11, 20 and 21. In specific non-limiting examples, the nucleotide sequence of the recombinant adenovirus genome comprises or consists of any one of SEQ ID NOs: 3-7, 9-11, 20 and 21.

In some embodiments, the adenovirus is an adenovirus type 5 (Ad5). In other embodiments, the adenovirus is an Ad2, Ad3, Ad9, Ad11, Ad12 or Ad34. In yet other embodiments, the adenovirus is a chimeric adenovirus, such as, but not limited to, an Ad5/Ad9 or Ad5/Ad34 chimeric adenovirus.

Further provided herein are recombinant adenoviruses that include a recombinant adenovirus genome disclosed herein.

Also provided are methods for measuring replication kinetics of a recombinant adenovirus, such as a recombinant adenovirus disclosed herein. In some embodiments, the genome of the recombinant adenovirus includes a heterologous ORF encoding a fluorescent protein and a self-cleaving peptide coding sequence, both operably linked to and in the same reading frame as an endogenous adenovirus ORF selected from E1B-55k, DNA polymerase, DNA-binding protein (DBP), adenovirus death protein (ADP), E3-14.7k and E4-ORF2. The self-cleaving peptide coding sequence is located between the heterologous ORF and the endogenous adenovirus ORF. In some embodiments, the method includes transfecting cells with the genome of the recombinant adenovirus, or infecting cells with particles of the recombinant adenovirus; culturing the transfected cells or infected cells for at least two days; measuring fluorescence at regular intervals throughout the culture period; and calculating log-slope from the fluorescence measurements. In some examples, the cells are cultured in a multi-well plate.

In some embodiments, the endogenous ORF is E1B-55k and the heterologous ORF is 3' of E1B-55k; the endogenous ORF is DNA polymerase and the heterologous ORF is 5' of DNA polymerase; the endogenous ORF is DNA-binding protein (DBP) and the heterologous ORF is 3' of DBP; the endogenous ORF is adenovirus death protein (ADP) and the heterologous ORF is 5' of ADP; the endogenous ORF is E3-14.7k and the heterologous ORF is 3' of E3-14.7k; or the endogenous ORF is E4-ORF2 and the heterologous ORF is 5' of E4-ORF2. In some examples, the recombinant adenovirus further includes a second heterologous ORF.

In some embodiments, the replication kinetics of the recombinant adenovirus is measured in a first cell type and a second cell type. In some examples, the first cell type is a tumor cell (such as from any of the tumor types listed above) and the second cell type is a non-tumor cell (such as a normal mammalian cell).

In some embodiments, the transfected cells or infected cells are cultured for at least two days, at least three days, at least four days, at least five days, at least six days or at least 7 days. In some examples, the transfected cells or infected cells are cultured for about 2 days to about 14 days, such as about 4 days to about 12, or about 6 days to about 10 days. In specific non-limiting examples, the transfected cells or infected cells are cultured for about 2, about 3, about 4, about 5, about 6, about 7, about 8, about 8, about 9, about 10, about 11, about 12, about 13 or about 14 days.

In some embodiments, fluorescence is measured approximately every 2 minutes, every 4, minutes, every 6 minutes, every 8 minutes, every 10 minutes, every 15 minutes, every 20 minutes, every 30 minutes, every 45 minutes, every 60 minutes, every 90 minutes, or every 120 minutes. In some examples, fluorescence is measured using a fluorescence plate reader, such as a TECAN™ fluorescence plate reader.

In some embodiments of the virus replication kinetics assay, the method includes transfecting cells with the genome of the recombinant adenovirus. In some examples, transfection results in approximately 5-10% of cells transfected.

In other embodiments of the virus replication kinetics assay, the method includes infecting cells with particles of the recombinant adenovirus. In some examples, the cells are infected with serial dilutions of the recombinant adenovirus particles. A suitable number of virus dilutions can be selected by one of skill in the art. In some examples, about 4 to about 24 dilutions of virus are used in the assay, such as about 4 to about 20, about 6 to about 16 or about 8 to about 12 dilutions. In particular examples, at least 4, at least 5, about 6, about 7 or at least 8 dilutions are used in the assay. In specific non-limiting examples, the dilutions are 1:100, 1:300, 1:900, 1:2700, 1:8100, 1:24,300, 1:72,900 and 1:218,700.

In some embodiments, the method includes selecting an appropriate therapeutic adenovirus for treatment of a patient's tumor by measuring replication kinetics of a recombinant adenovirus in tumor cells obtained from the patient, wherein the recombinant adenovirus corresponds to the therapeutic adenovirus, except that a therapeutic ORF of the therapeutic adenovirus is replaced with an ORF encoding a fluorescent protein. In some examples, the therapeutic adenovirus is an oncolytic adenovirus. In some examples, the tumor cells are obtained from a biopsy.

In some embodiments, the method includes selecting a cancer patient that would respond to treatment with a therapeutic adenovirus by measuring replication kinetics of a recombinant adenovirus in tumor cells obtained from the patient, wherein the recombinant adenovirus corresponds to the therapeutic adenovirus, except that a therapeutic ORF of the therapeutic adenovirus is replaced with an ORF encoding a fluorescent protein. This method can be used, for example, to stratify cancer patients as predicted responders and predicted non-responders to a particular therapeutic adenovirus. In some examples, the therapeutic adenovirus is an oncolytic adenovirus. In some examples, the tumor cells are obtained from a biopsy.

In some embodiments, the method includes identifying the most efficacious therapeutic adenovirus for a patient's tumor by measuring replication kinetics of a panel of recombinant adenoviruses in tumor cells obtained from the patient, wherein the recombinant adenoviruses correspond to candidate therapeutic adenoviruses, except that a therapeutic ORF of the therapeutic adenoviruses is replaced with an ORF encoding a fluorescent protein. In some examples, the therapeutic adenoviruses are oncolytic adenoviruses. In some examples, the tumor cells are obtained from a biopsy.

Further provided herein are kits that include a recombinant adenovirus genome or a recombinant adenovirus disclosed herein; and cells, cell culture media and/or a multi-well plate. In some embodiments, the cells are tumor cells (such as cells from any of the tumor types listed herein). In some embodiments, the cells are non-tumor cells. In some embodiments, the cell culture media is selected such that it provides a high signal-to-background ratio. In some examples, the cell culture media is free of phenol red. In some embodiments, the multi-well plate is a 48-well, a 96-well or a 384-well plate. In particular examples, the multi-well plate is any plate that can be read on a fluorescence plate reader, such as a TECAN™ fluorescence plate reader.

IV. Optimal Placement of Exogenous ORFs

The 36 kb Adenovirus genome is compact, using both the top and bottom strands for coding of various genes. At many locations within the adenovirus genome, both the top and bottom strand are used simultaneously for coding separate genes. The genome size has evolved to be optimal for insertion into its capsid. As a result, the insertion of exogenous genes is limited by the size capacity of the capsid as excessive addition of exogenous nucleic acid leads to incomplete genome loading into the capsid and reduced viral kinetics.

A solution to the challenge presented by the limited available space in the adenovirus genome is to locate exogenous open reading frames (ORFs) as fusion products within native adenovirus ORFs. This strategy makes use of adenovirus promoters, 5'UTRs, and polyA tails already encoded in the genome. However, expression of a fusion between a native adenovirus protein and an exogenous protein can be deleterious to one or both protein functions and lead to a significant decrease in adenovirus replication kinetics.

The present disclosure provides a solution to this problem by using a self-cleaving peptide sequence placed between the native ORF and the exogenous ORF. When placed between the two ORFs on a single mRNA, the presence of the self-cleaving peptide sequence leads to ribosome skipping and release of the first protein separate from the second protein. In some embodiments disclosed herein, the self-cleaving peptide is a 2A peptide (P2A).

Also disclosed herein is the identification of optimal placement sites for exogenous ORFs within the adenovirus genome. The combination of the self-cleaving peptide sequence and the judicious placement of the exogenous ORF leads to high expression and minimal to no impact on viral kinetics. Further disclosed herein is use of the recombinant adenoviruses expressing exogenous genes in a high throughput assay for measuring viral replication kinetics.

As described in Example 1 below, several sites within the adenovirus genome were identified that upon insertion of a heterologous ORF, did not inhibit adenovirus replication kinetics. In particular, it was determined that a heterologous ORF could be inserted C-terminal to the E1B-55k ORF, N-terminal to the DNA polymerase ORF, C-terminal to the DBP ORF, N-terminal to the ADP ORF, C-terminal to the E3-14.7k ORF or N-terminal to E4-ORF2. In each instance, a self-cleaving peptide sequence (P2A site) was inserted between the adenovirus ORF and the heterologous ORF. Therefore, the present disclosure contemplates the use of the following recombinant adenovirus in assays to measure replication kinetics (where "SC" refers to a sequence encoding a self-cleaving peptide, such as P2A):

E1B-55k-SC-heterologous ORF heterologous ORF-SC-(DNA polymerase)

DBP-SC-heterologous ORF heterologous ORF-SC-ADP

E3-14.7k-SC-heterologous ORF heterologous ORF-SC-E4-ORF2

In some embodiments herein, the self-cleaving peptide is a virally encoded 2A peptide, or a modified version thereof as described further below.

V. Self-Cleaving Peptide Sequences

Self-cleaving peptides are peptides that induce the ribosome to skip the synthesis of a peptide bond at the C-terminus, leading to separation of the peptide sequence and a downstream polypeptide. The use of self-cleaving peptides allows for expression of multiple proteins flanking the self-cleaving peptide from a single ORF. Virally encoded 2A peptides are one type of self-cleaving peptide.

As with other self-cleaving peptides, 2A peptides function by making the ribosome skip the synthesis of a peptide bond at the C-terminus of a 2A element, leading to separation between the end of the 2A sequence and the downstream peptide (Kim et al., *PLoS One* 6(4):e18556, 2011). The "cleavage" occurs between the glycine and proline residues found on the C-terminus of the 2A peptide. Exemplary 2A peptides include, but are not limited to, the 2A peptides encoded by Thosea asigna virus (TaV), equine rhinitis A virus (ERAV), porcine teschovirus-1 (PTV1) and foot and mouth disease virus (FMDV), or modified versions thereof In particular examples herein, the 2A peptide comprises PTV1 2A (P2A), FMDV 2A (F2A), ERAV 2A (E2A) or TaV 2A (T2A), the sequences of which are show below and are set forth herein as SEQ ID NOs: 12-15.

```
P2A:
                              (SEQ ID NO: 12)
ATNFSLLKQAGDVEENPGP

F2A:
                              (SEQ ID NO: 13)
VKQTLNFDLLKLAGDVESNPGP

E2A:
                              (SEQ ID NO: 14)
QCTNYALLKLAGDVESNPGP

T2A:
                              (SEQ ID NO: 15)
EGRGSLLTCGDVEENPGP
```

In some examples, the 2A peptide is modified to include Gly-Ser-Gly at the N-terminus to improve cleavage efficiency. The sequences of modified P2A, F2A, E2A and T2A are shown below and are set forth herein as SEQ ID NOs: 16-19.

```
Modified P2A:
                                    (SEQ ID NO: 16)
GSGATNFSLLKQAGDVEENPGP Modified F2A:
                                    (SEQ ID NO: 17)
GSGVKQTLNFDLLKLAGDVESNPGP Modified E2A:
                                    (SEQ ID NO: 18)
GSGQCTNYALLKLAGDVESNPGP Modified T2A:
                                    (SEQ ID NO: 19)
GSGEGRGSLLTCGDVEENPGP
```

In some embodiments, the 2A polypeptide is a variant of a 2A polypeptide disclosed herein. Variants can include polypeptide sequences having at least 80%, at least 85%, at least 90%, at least 95%, at least 96%, at least 97%, at least 98%, at least 99%, or more, sequence identity to a wild-type or modified 2A polypeptide disclosed herein. Variants can include, for example, a deletion of at least one N-terminal amino acid from the 2A polypeptide of any one of SEQ ID NOs: 12-19, for example a deletion of 1, 2, 3, 4 or 5 amino acids, including ranges between any two of the listed values. Variants can include a deletion of at least one C-terminal amino acid from the 2A polypeptide of any one of SEQ ID NOs: 12-19, for example a deletion of 1, 2, 3, 4 or 5 amino acids, including ranges between any two of the listed values. Variants can also include, for example, at least 1, 2, 3, 4 or 5 amino acid substitutions, such as conservative amino acid substitutions.

VI. Method for Monitoring Viral Kinetics in Tissue Culture

The critical criteria for assessment of selectively replicating viruses is comparing viral growth kinetics between cancer and normal cells over multiple rounds of replication. Subtle differences in virus replication can be masked at high MOIs. Measuring multiple rounds of virus replication can overcome this problem.

To address the need for a rapid virus kinetics assay, a systematic high throughput screen for viral replication kinetics is needed. Current methods of evaluating virus replication often rely on specific cell lines that have incorporated luciferase or a reporter. However, the activity and level of transgene expression conferred by the encoded reporter measures cell viability, not viral replication per se. Furthermore, adenovirus proteins disrupt global gene expression (such as p300, E2F, CBP, mediator, splicing etc.).

Current methods of assessing adenovirus replication are indirect, insensitive endpoint assays that can only be used in certain cell types; depend on Ad5-specific antibodies; do not measure an entire viral life cycle over multiple rounds; require knowledge of viral titer; cannot use transfection of viral plasmids; do not quantify viral replication; do not predict cell killing; and do not enable comparisons between different subgroups.

Assays currently in use include (1) measuring Ad5 late viral proteins via western blot; (2) measuring adenoviral genomes via q-PCR; (3) plaque assays in specialized and limited cell types; (4) indirectly measuring viral replication using cell viability assays (such as wst-1/mtt); and (5) ELISA using adenovirus-specific antibodies and/or FACS.

Each of these assays has significant disadvantages. The first two methods do not measure the entire viral life-cycle, which includes such steps as viral uptake, gene expression, viral gene replication, capsid assembly, genome loading into the capsid, lysis, spread, and productive secondary infection, thus significantly limiting the utility of these methods.

Plaque assays require specialized cell-lines and efficient viral infection and complementation, which makes it difficult to compare the replication for different Ad serotypes, of which there are 68. In addition, plaque assays require cells to survive an agar overlay, which is only possible with limited cell types. Furthermore, plaque assays are inherently subjective, highly laborious, and provide no insight as to where virus replication is selectively impaired or enhanced (such as at initial infection, gene expression, replication, lysis etc.). Moreover, determination of the proper titer of a capsid-swap virus by methods such as plaque assay or ELISA are not possible because the choice of cell type can effect virus entry. Also, Ad5 antibodies do not recognize fiber swaps employed for altering virus tropism.

In regard to ELISA and FACS assays, these methods depend on using specific antibodies to adenovirus proteins and quantifying titer by detecting antibody binding by FACS or ELISA. However, the antibodies used in traditional assays only recognize specific serotypes and cannot be used to compare viral kinetics or different adenoviruses as they are not recognized by the available antibodies.

As disclosed herein, the incorporation of a fluorescent reporter expressed coincident with one or more viral proteins allows one to measure viral kinetics using methods similar to those used to measure growth of bacteria or yeast. In the methods disclosed herein, fluorescent expression levels are monitored over time and fit to a log growth curve, similar to measuring optical density (OD) of a bacterial or yeast culture to determine log-slope growth rate. Since log-slope is the only pertinent parameter, this method is robust against variations or errors in initial infection titer and can even be employed with transfection of the whole-genome plasmid instead of infection with purified virions.

Monitoring of fluorophore expression over time in tissue culture provides a non-invasive, multi-time point measure of viral progression. These measurements provide detailed information regarding the viral kinetics over several rounds of replication and thus include all aspects of the viral life cycle.

The fluorescent-based assay disclosed herein is high throughput and is tolerant to variations in initial virus titer and viral entry. This assay is so tolerant to initial conditions that it is possible to skip virion production and purification and simply use direct transfection of whole-genome plasmids produced by the previously described Adsembly and AdSLIC protocols (see WO2012/024351, which is incorporated by reference herein). Several weeks of time and a large volume of reagents, media, and tissue culture supplies are saved in the process. The assays disclosed herein are an indispensable tool for the rapid and accurate assessment of viral constructs.

In addition, the methods of assessing viral kinetics can be applied to any adenovirus serotype as well as any cell line, and is independent of the starting virus titer, the type of fluorophore selected and the viral protein half-life.

Viral kinetics is determined from the log-slope of measured fluorescence over multiple time points, in some instances covering up to about 10 days. This length of time is often optimal to capture several viral lifecycles, each of which last approximately 48 hours. In some embodiments, fluorescence is measured for at least two days, at least three days, at least four days, at least five days, at least six days or at least 7 days. In some examples, fluorescence is measured for about 2 days to about 14 days, such as about 4 days to about 12, or about 6 days to about 10 days. In specific non-limiting examples, fluorescence is measured for about 2, about 3, about 4, about 5, about 6, about 7, about 8, about 8, about 9, about 10, about 11, about 12, about 13 or about 14 days.

Comparing kinetics between different viral constructs, each with a potentially different fluorophore and signal level, can be addressed by use of log-slope. Taking the slope of the logarithm of the exponential growth in fluorescence signal vs. time results in a single value for each viral construct that can be cross-compared regardless of signal magnitudes or any initial time delay that might occur before exponential growth begins. This feature of data interpretation makes the assay insensitive to initial starting points. Poor control or even knowledge of initial viral titer has no impact on the log-slope during exponential growth. All that is necessary is an initial infection (or transfection) that results in transduction of a small fraction of cells in the tissue culture dish. The remaining, unaffected cells are available for secondary and tertiary infection.

Since this assay requires fluorescence measurements made at multiple time points over a period of days, a reference standard must be found that allows normalization across data points. This reference standard must be stable over time, temperature, humidity, and exposure to the excitation radiation used for fluorescence measurements. In some embodiments, the reference standard is background fluorescence from the polystyrene of empty wells. In other embodiments, a commercially available latex bead with embedded fluorophore is the reference standard.

The cell culture media used for the assay disclosed herein ideally provides a high signal-to-background ratio. Factors that lead to high background include phenol red or FBS in the media. Thus, in some embodiments, the culture media used in viral kinetic assays is media free of phenol red. The selection of fluorophore can also be selected to overcome background fluorescence from media. For examples, YPet is 2× brighter than enhanced GFP (eGFP). Thus, in some embodiments, the fluorescent protein is YPet. In other embodiments, the fluorescent protein is mCherry.

VI. Adsembly and AdSLIC

The adenovirus genome is organized into several functional groups, labeled E1, E2, E3, E4, and L1-5. The E1 region encodes proteins that control the transcription of all other viral genes and induces S-phase in the host cell. The E2 region encodes proteins that drive viral DNA replication. The E3 region proteins modulate host cell immune response and are dispensable in cell culture. The E4 region contains genes for a disparate set of functions. And the L1-5 region encodes the viral particle structural proteins.

Figure 6A:
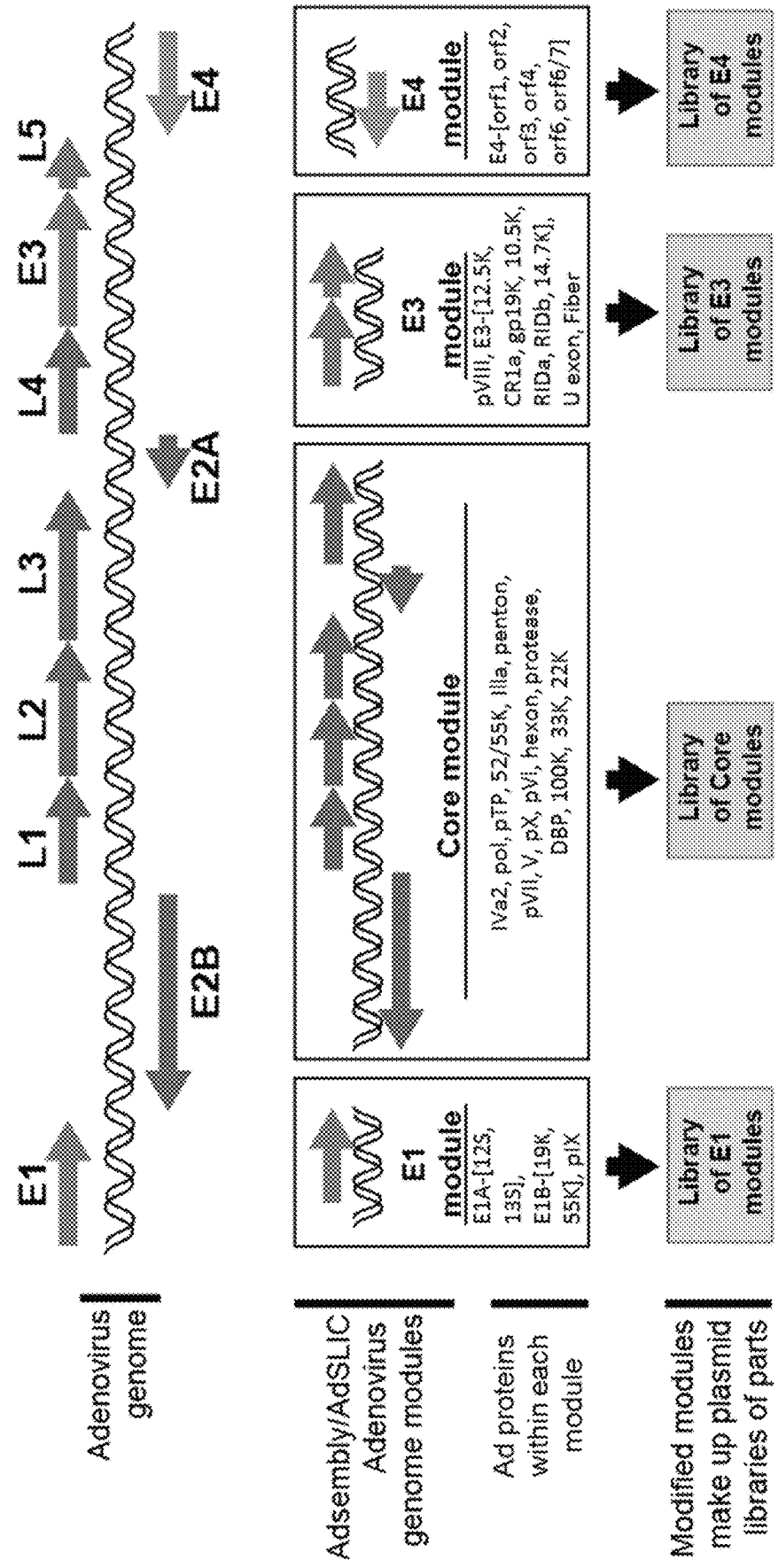
FIGS. 6A-6C provide a schematic overview of the Adsembly and AdSLIC techniques for the combinatorial assembly of recombinant adenoviruses.

Taking advantage of this natural segregation of functionality, the inventors previously developed a method of recombinant adenovirus assembly that allows quick and easy manipulation of the 36 kb Ad genome by separating it into 4 plasmids, E1, E3, E4, and Core, as shown in FIG. 6A (Adsembly and AdSLIC; see WO2012/024351, which is incorporated herein by reference). Because of their more reasonable size, manipulation of these smaller plasmids is straightforward using standard techniques.

Figure 6B:
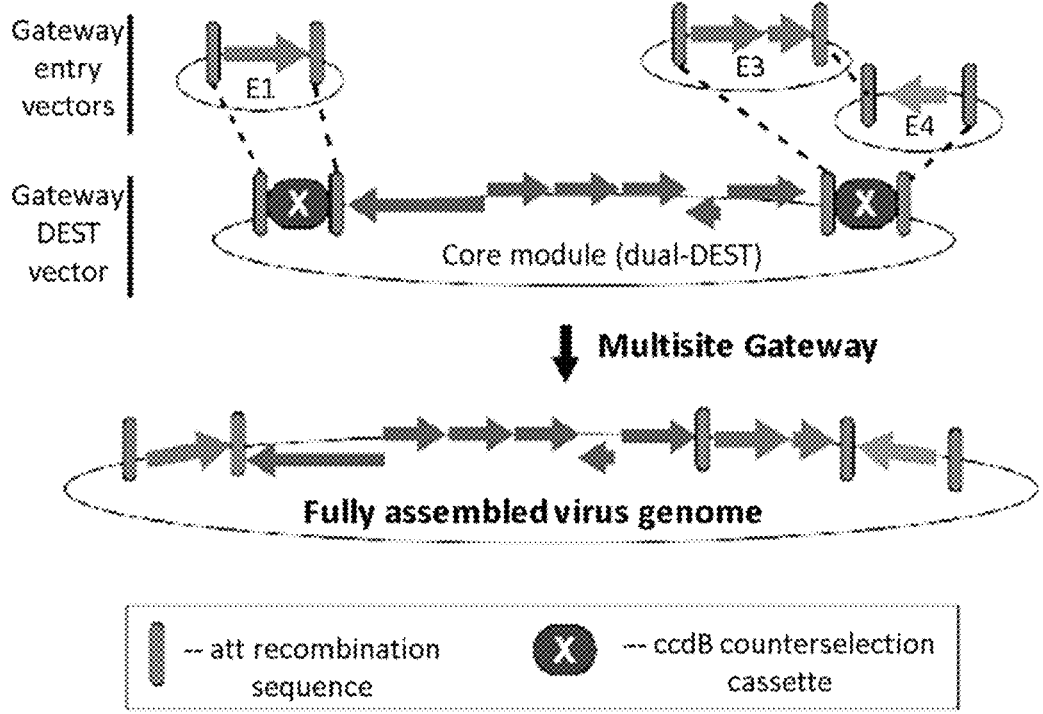
Figure 6C:
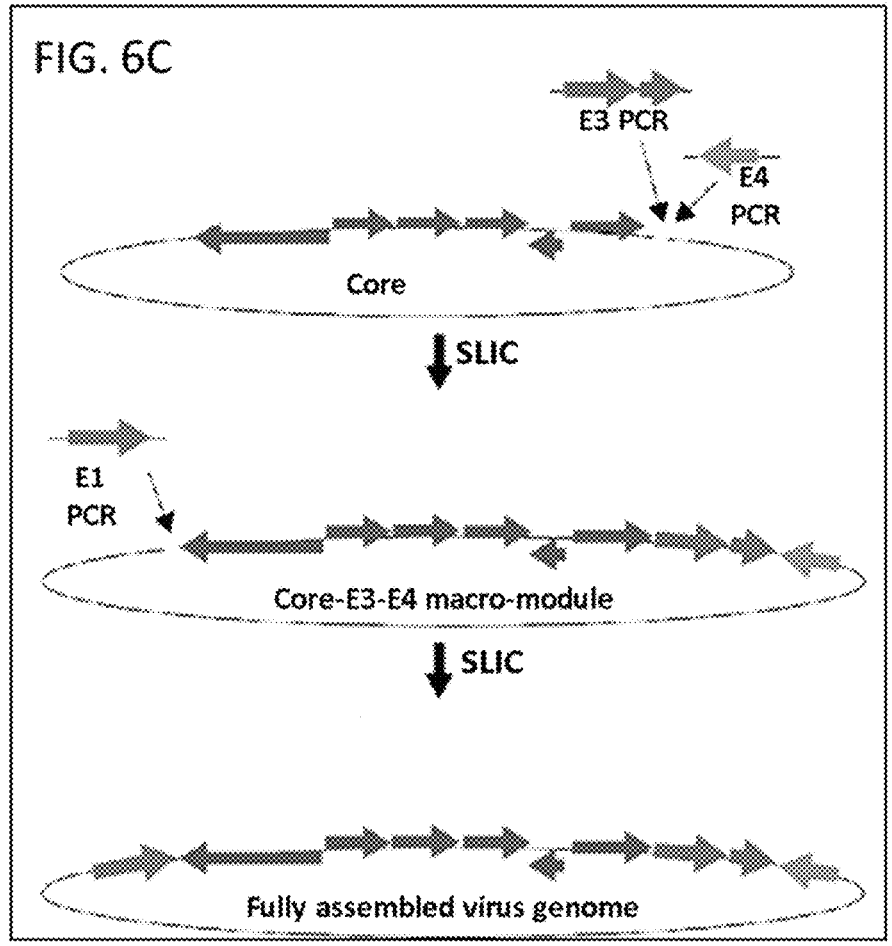

Adsembly and AdSLIC enable the combinatorial in vitro assembly of adenoviruses with novel properties from compatible genomic library parts in 4 hours. Adsembly and AdSLIC provide a common genome design platform that enables synthetic viruses with novel properties to be assembled using four libraries of functional parts (FIG. 6A). These libraries of parts can be re-assembled in all possible combinations using either multi-site specific recombination sites (Adsembly; FIG. 6B) or sequence independent seamless cloning (AdSLIC; FIG. 6C).

The Adsembly and AdSLIC technologies enable the modular design and production of adenoviruses with unique capabilities. Developing the capability to design, manufacture, and test viruses in an automated, high-throughput manner will accelerate and expand the development of new viruses for therapeutic, diagnostic, and research studies.

While the cloning step was once the bottleneck for producing new viral constructs, the advent of Adsembly and AdSLIC have made it such that the ability to construct viral genomes has outpaced the ability to test them. An equally high throughput kinetics assay is critical to exploit the full potential and high content assembly of synthetic and personalized viral therapies and diagnostics using the Adsembly and AdSLIC methods.

The following examples are provided to illustrate certain particular features and/or embodiments. These examples should not be construed to limit the disclosure to the particular features or embodiments described.

EXAMPLES

Example 1: Identification of Optimal Locations in the Adenovirus Genome for Exogenous ORFs This example describes the identification of specific locations within the adenovirus genome where exogenous ORFs can be inserted, along with a self-cleaving peptide sequence, without disrupting virus kinetics.

The insertion of exogenous genes in adenovirus vectors is limited by the size capacity of the adenovirus capsid. Excessive addition of exogenous nucleic acid leads to incomplete genome loading into the capsid and reduced viral kinetics. A solution to the challenge presented by the limited available space in the adenovirus genome is to locate exogenous open reading frames (ORFs) as fusion products within native adenovirus ORFs. This strategy makes use of adenovirus promoters, 5′UTRs, and polyA tails already encoded in the genome. However, expression of a fusion between a native adenovirus protein and an exogenous protein can be deleterious to one or both protein functions and lead to a significant decrease in adenovirus replication kinetics. In fact, studies disclosed herein demonstrate that direct fusion of an exogenous ORF to the adenovirus E1A, DNA polymerase or ADP ORFs significantly inhibits adenovirus replication kinetics. In addition, the inventors previously tried using an internal ribosomal entry site (IRES) to insert exogenous ORFs, which also failed to produce recombinant virus with wild-type kinetics.

This example describes a solution to this problem by using a self-cleaving peptide sequence placed between the native adenovirus ORF and the exogenous ORF. When placed between the two ORFs on a single mRNA, the presence of the self-cleaving peptide sequence leads to ribosome skipping and release of the first protein separate from the second protein. The adenovirus constructs generated in this example using the self-cleaving peptide P2A and a fluorescent protein (e.g. YPet, mCherry) as the exogenous ORF.

The table below provides a list of the constructs that were generated and indicates the expression level of the exogenous ORF (low, medium or high) and the level of virus replication kinetics (low, medium or high) in two different cells lines—293-E4 cells and A549 cells.

| Construct | Designation | SEQ ID NO: | Expression Level | Kinetics in 293-E4 cells | Kinetics in A549 cells |
|---|---|---|---|---|---|
| YPet-GS-E1A | CMBT-352 | | Low | High | Low |
| YPet-P2A-E1A | CMBT-379 | 1 | High | High | Medium |
| E1A-P2A-YPet | CMBT-432 | 2 | Medium | High | Medium |
| E1A-P2A-YPet-PEST | CMBT-569 | | Medium | High | Medium |
| E1A-P2A-mCherry | CMBT-455 | | Medium | High | Medium |
| E1B-55k-P2A-YPet | CMBT-456 | 3 | High | High | High |
| E1B-55k-P2A-mCherry | CMBT-499 | 4 | High | High | High |
| YPet-P2A-(DNA Poly) | CMBT-530 | 5 | Medium | High | High |
| YPet-(DNA Poly) | CMBT-590 | | Medium | None | Not tested |
| DBP-GS-BFP | CMBT-612 | | High | High | Not tested |
| DBP-P2A-YPet | CMBT-886 | 6 | High | High | High |
| mCherry-GS-ADP | CMBT-402 | | High | Medium | Not tested |
| ΔADP[mCherry] | CMBT-599 | | High | High | Medium |
| YPet-P2A-ADP | CMBT-403 | 7 | High | High | High |
| ADP-P2A-YPet | CMBT-429 | 8 | High | Low | None |
| E3-14.7k-P2A-YPet | PCMN-887 | 9 | High | High | High |
| YPet-P2A-E4-ORF2 | CMBT-457 | 10 | Medium | High | High |
| mCherry-P2A-E4-ORF2 | CMBT-633 | 11 | Medium | High | High |

Constructs exhibiting "high" replication kinetics (i.e. replication kinetics that are comparable to wild-type adenovirus) in both cell types are considered candidates for use in the virus replication kinetics assays described in Example 2 (candidate constructs are shown in bold).

Comparison of Direct Fusion and Insertion of a P2A Site

Several constructs were generated in which a fluorescent protein was fused directly to an adenovirus ORF. In particular, the following direct fusions were generated: YPet-E1A, YPet-(DNA polymerase) and mCherry-ADP.

YPet-E1A adenovirus exhibited a significant impairment in virus kinetics. Insertion of the P2A site between YPet and E1A (YPet-P2A-E1A) improved virus kinetics, but did not restore virus kinetics to wild-type level. Another construct was then generated to test fusion of P2A and YPet to the C-terminal end of E1A (E1A-P2A-YPet). This construct further improved virus kinetics, but again did not restore kinetics to the level of wild-type adenovirus.

Multiple attempts at transfecting the YPet-(DNA-poly) genome plasmid failed to produce viable virus (no plaques were formed). However, fusion of YPet-P2A to the N-terminus of DNA polymerase (YPet-P2A-(DNA poly)) produced a virus with wild-type kinetics, as shown in the table above.

Finally, the direct fusion of mCherry to ADP (mCherry-ADP) produced a virus with significantly impaired kinetics. However, insertion of the P2A site between the mCherry ORF and the ADP ORF resulted in a virus with wild-type kinetics (mCherry-P2A-ADP). The same result was obtained using a different fluorescent protein; the YPet-P2A-ADP construct exhibited wild-type virus kinetics. However, placement of P2A and the heterologous ORF on the C-terminal side of ADP produced a virus that did not replicate. Thus, for the ADP, the heterologous ORF must be placed at the N-terminus.

Additional Constructs with Wild-Type Virus Kinetics

Figure 7:
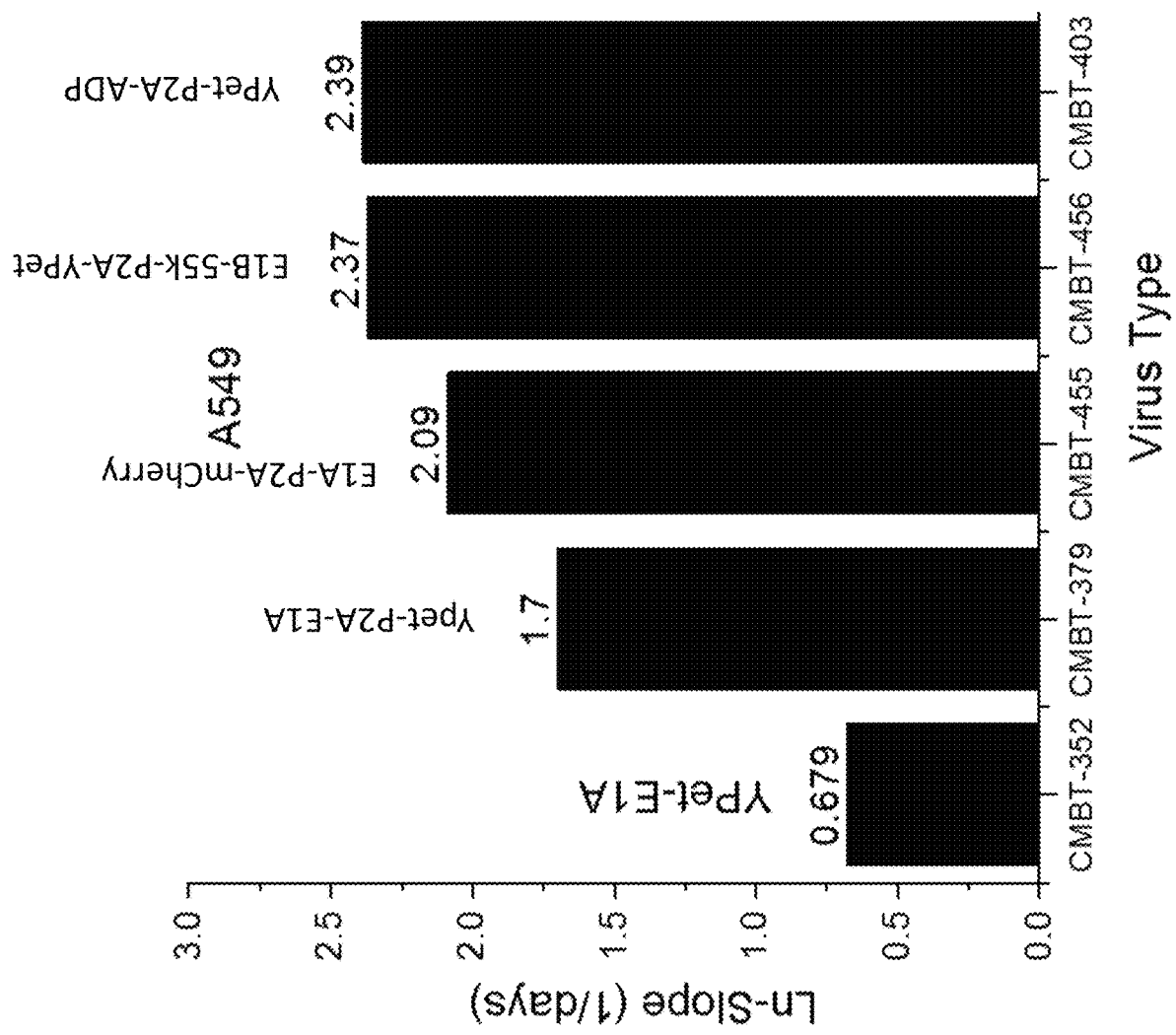
FIG. 7 is a bar graph showing ln-slope values for recombinant adenoviruses encoding a fluorescent protein in the E1 region. Shown are the values for the direct fusion construct YPet-E1A, and the YPet-P2A-E1A, E1A-P2A-mCherry and E1B-55k-P2A-YPet constructs, which each contain a P2A site. The YPet-P2A-ADP construct is shown for comparison.

FIG. 7 shows a comparison of Ln-Slope of five different constructs: YPet-E1A, YPet-P2A-E1A, E1A-P2A-mCherry, E1B-55k-P2A-YPet and YPet-P2A-ADP. As discussed above, direct fusion of YPet to E1A produced a virus with significantly impaired kinetics, and addition of the P2A site at either the N-terminus (YPet-P2A-E1A) or the C-terminus (E1A-P2A-mCherry) improved virus kinetics but not to wild-type levels. However, inserting the P2A site and a heterologous ORF at the C-terminus of E1B-55k (E1B-55k-P2A-YPet) or the N-terminus of ADP (YPet-P2A-ADP) generated a recombinant virus with wild-type virus kinetics.

Evaluation of viral kinetics for constructs having a P2A site and heterologous ORF on the C-terminus of DBP (DBP-P2A-YPet) or the C-terminus of E3-14.7k (E3-14.7k-P2A-YPet), or having a P2A site and heterologous ORF on the N-terminus of E4-ORF2 (YPet-P2A-E4-ORF2 and mCherry-P2A-E4-ORF2) produced viruses with wild-type replication kinetics.

The results of these data demonstrate that at least the following adenovirus genome constructs can be used on the viral replication assays described in Example 2:

E1B-55k-SC-heterologous ORF heterologous ORF-SC-(DNA polymerase)

DBP-SC-heterologous ORF heterologous ORF-SC-ADP

E3-14.7k-SC-heterologous ORF heterologous ORF-SC-E4-ORF2

For use in the virus replication assays disclosed herein, the heterologous ORF encodes a fluorescent protein, such as (but not limited to) YPet or mCherry.

Other Adenovirus Serotypes

Figure 9A:
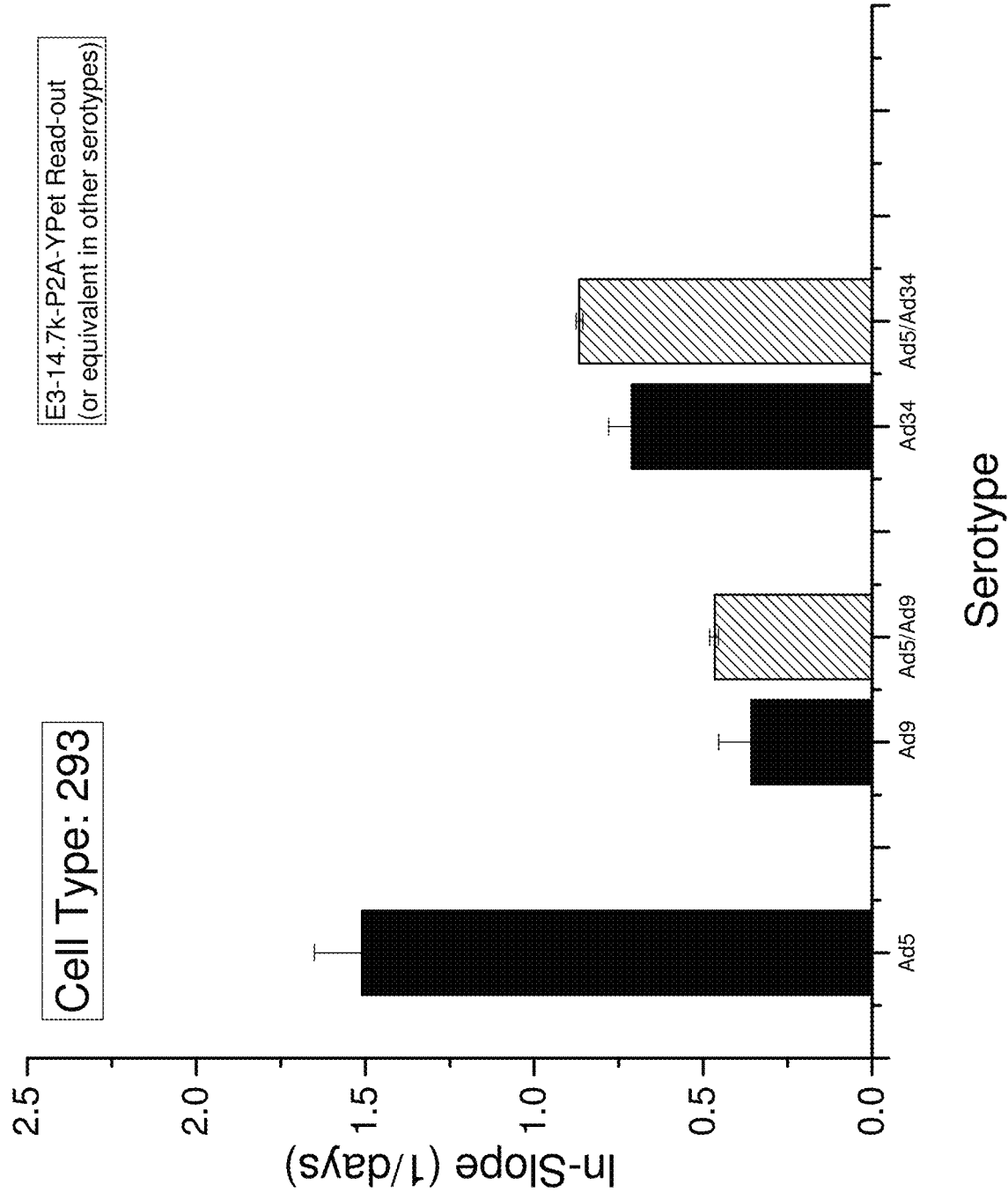
FIGS. 9A-9C are bar graphs showing ln-slope values for recombinant adenoviruses derived from Ad5, Ad9 or Ad34 and containing a heterologous ORF 3' of the E3-14.7k ORF (or equivalent thereof in Ad9 and Ad34). Shown are the values for Ad5 (E3-14.7k-P2A-YPet; PCMN-887), Ad9 (E3-15k-P2A-YPet; PCMN-888) and Ad34 (E3-14.8k-P2A-YPet; PCMN-889) in 293 cells (FIG. 9A), A549 cells (FIG. 9B) and U2OS cells (FIG. 9C). Also shown in each figure are values for chimeric viruses comprising an Ad5 core (including E3-14.7k-P2A-YPet) and fiber shaft/knob from either Ad9 (Ad5/Ad9) or Ad34 (Ad5/Ad34).
Figure 9B:
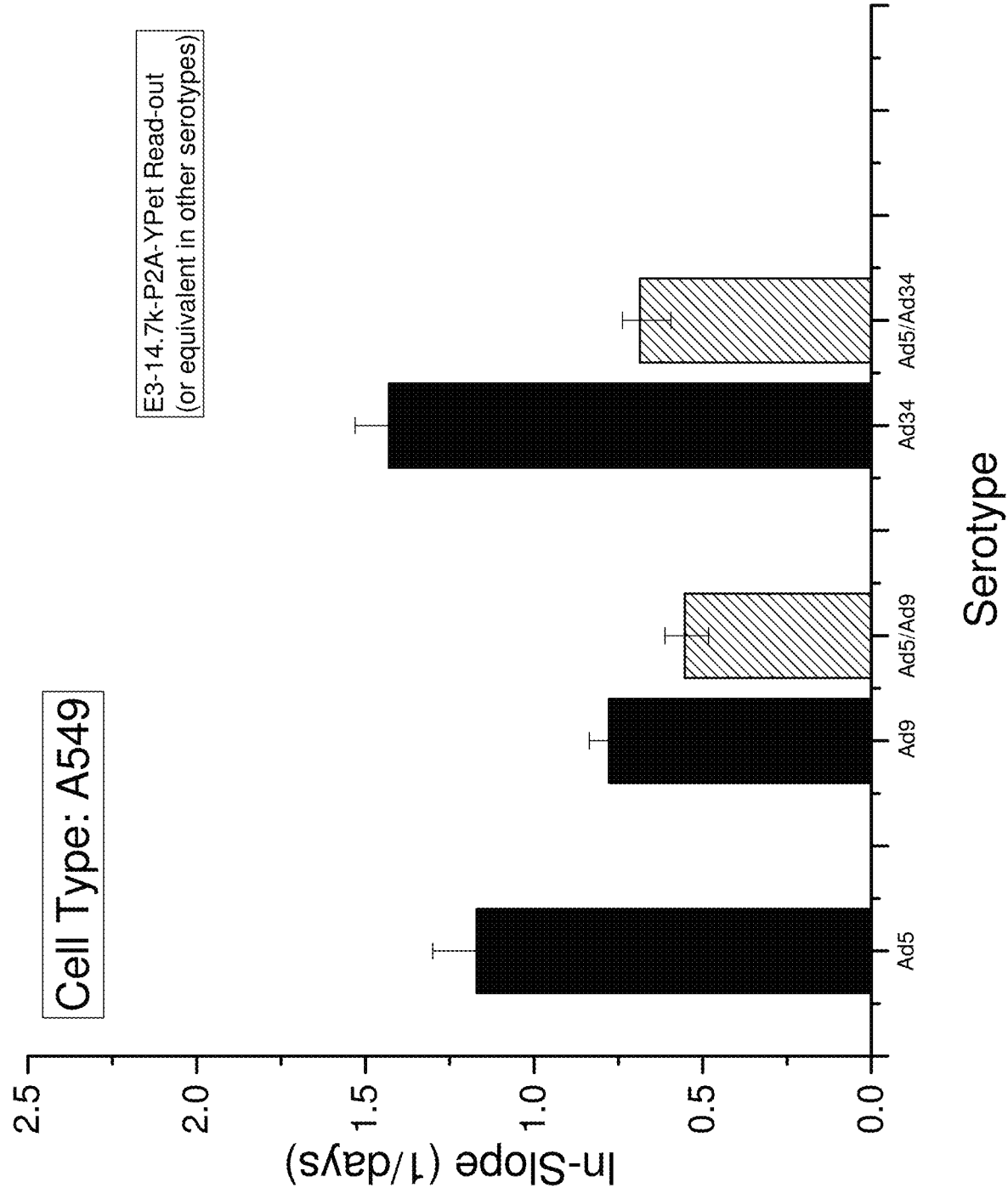
Figure 9C:
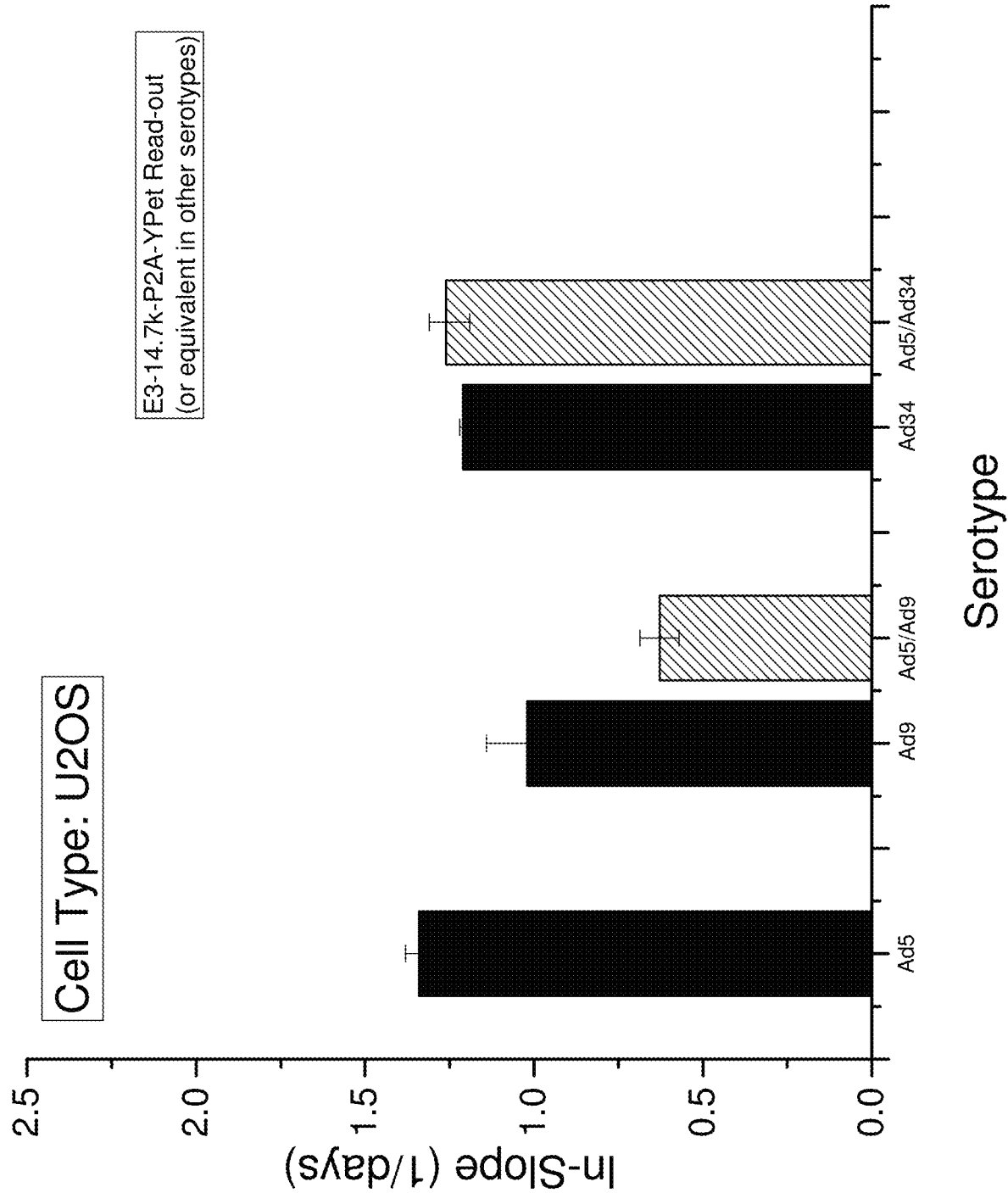

Previously described methods of measuring viral kinetics are all highly dependent upon cell-type specific assays and are thus serotype specific due to the divergent tropism of each adenovirus serotype. The adenovirus kinetic assay disclosed herein is not dependent upon any one cell type and so can be extended to serotypes other than Ad5. All adenovirus serotypes contain an ORF equivalent to Ad5 E3-14.7k. Therefore, viruses equivalent to Ad5 E3-14.7k-P2A-YPet (PCMN-887; SEQ ID NO: 9) were generated using Ad9 (containing E3-15k) and Ad34 (containing E3-14.8k): PCMN-888 (Ad9 E3-15k-P2A-YPet; SEQ ID NO: 20) and PCMN-889 (Ad34 E3-14.8k-P2A-YPet; SEQ ID NO: 21). Chimeric viruses containing the Ad5 core and a fiber shaft and knob from either Ad9 or Ad34 were also generated. The four recombinant viruses were then tested in the FBVK assay using 293 cells (FIG. 9A), A549 cells (FIG. 9B) and U2OS cells (FIG. 9C). All four recombinant viruses exhibited high levels of YPet expression with minimal impact on viral kinetics resulting from insertion of the exogenous ORF.

Example 2: Methods for Evaluating Adenovirus Replication Kinetics

Figure 3:
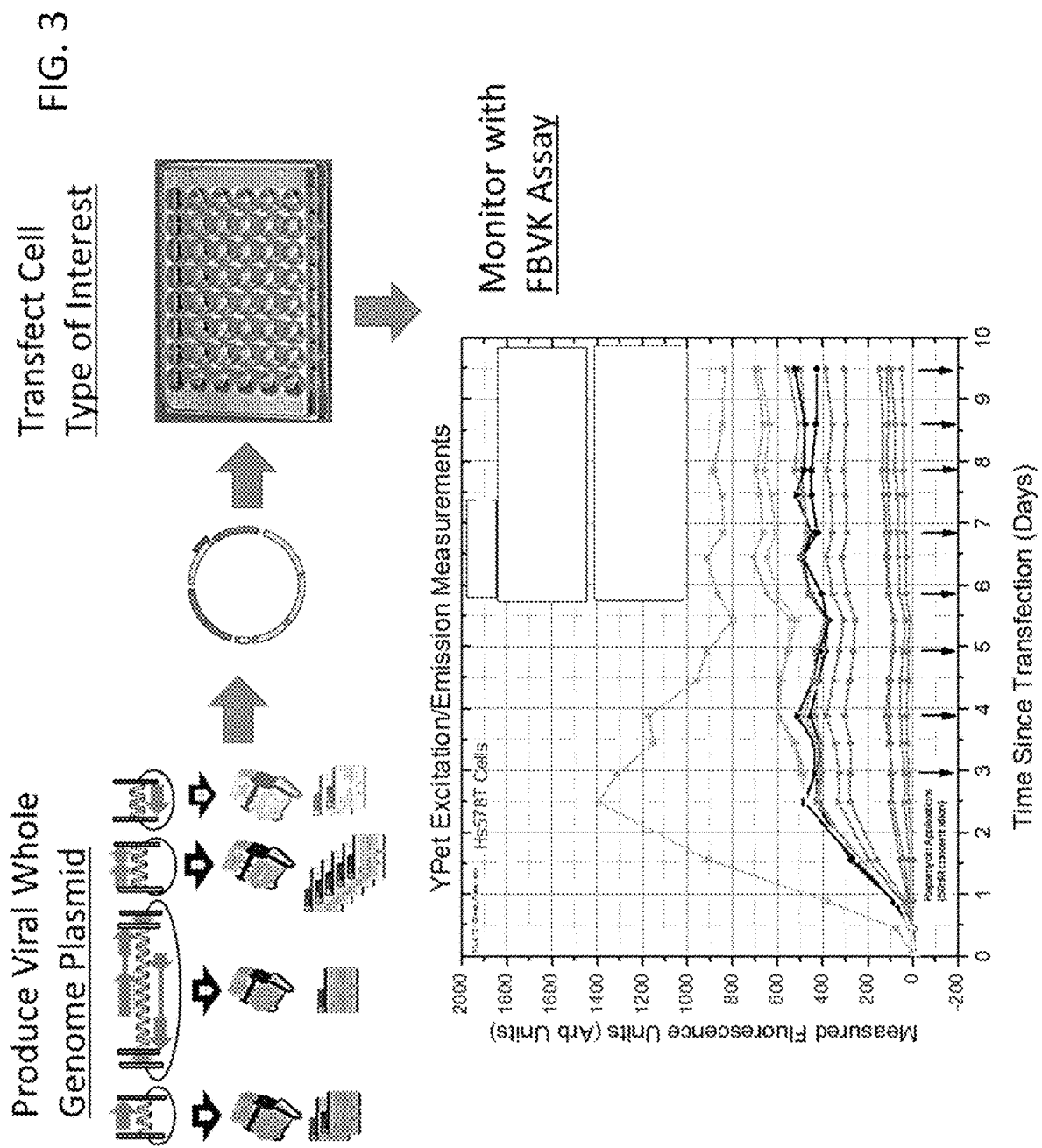
FIG. 3 is a schematic showing the work-flow of the fluorescence-based viral kinetic (FBVK) assay disclosed herein. Whole virus genome plasmid is produced (such as by Adsembly or AdSLIC) and used to transfect a cell type of interest in a multi-well plate. Alternatively, cells are infected with recombinant adenovirus particles. The adenovirus genome comprises at least one open reading frame (ORF) encoding a fluorescent protein in a location within the viral genome that does not substantially alter viral replication kinetics. Fluorescence is monitored over time to calculate viral replication kinetics.

The Adsembly and AdSLIC methods for assembling recombinant adenoviruses provide a means for generating large numbers of recombinant virus genomes and viruses in a short period of time. However, a need exists for a rapid and high-throughput method for evaluating replication kinetics of recombinant adenoviruses designed for clinical and therapeutic use. This example describes a fluorescence-based viral kinetics assay that can be used to test virus replication kinetics of recombinant adenoviruses (FIG. 3). The assay can be performed with either recombinant adenovirus genome plasmids or recombinant adenovirus particles as the starting material.

When starting with a recombinant adenovirus genome, the assay includes transfecting cells with adenovirus genome plasmids (such as those described above in Example 1) and monitoring fluorophore expression over time (FIGS. 4A-4B). Transfection conditions are selected such that about 5-10% of the cells are initially transfected. Cells that are not initially transfected are available for secondary infection by virus particles produced from the initial transfection. Log-slope is used as a measure of kinetics based on secondary, tertiary, and quarternary (etc.) infections, thus it is not necessary to know the percentage of cells that are initially transfected. FIGS. 4A and 4B show an exemplary virus-based kinetics assay starting with recombinant adenovirus genome plasmids. In this example, a 48-well plate is used, which allows for testing of 14 different virus constructs (in triplicate) simultaneously. The upper half of the 48-well plate (FIG. 4A) includes triplicate wells of six different viruses, 3 mock-infected wells and 3 "blank" wells with FLUORESBRITE™ beads, which compensate for tool sensitivity drift. The lower half of the 48-well plate (FIG. 4B) includes triplicate wells of eight different virus constructs. Once cells are transfected, the plate is placed in a TECAN™ plate reader for continuous fluorescence monitoring. The data collected is used to calculate ln-slope for each construct (FIG. 8).

Figure 5:
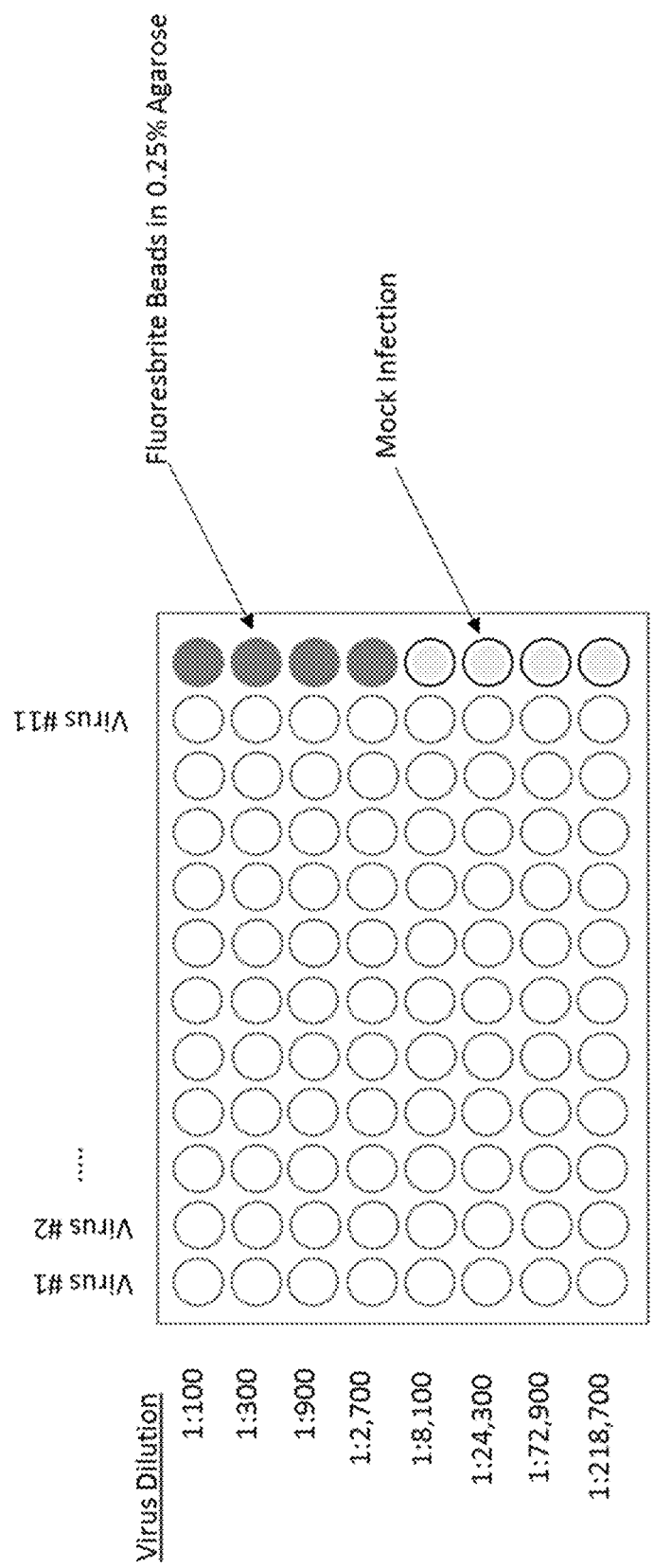
FIG. 5 outlines an exemplary kinetic assay setup when starting with recombinant virus. This assay does not require knowledge of virus titer. Recombinant virus is serially diluted and used to infect cells plated in a multi-well plate. In the example shown, a 96-well plate is used and each virus is diluted 1:100, 1:300, 1:900, 1:2700, 1:8100, 1:24,300, 1:72,900 and 1:218,700, allowing for the testing of 11 viruses simultaneously. Four wells are mock-infected and FLUORESBRITE™ beads are placed in four wells to compensate for tool sensitivity and drift. The multi-well plate is placed on a plate reader (such as a TECAN plate reader) for continuous fluorescence monitoring.

The assay can also be carried out by infecting cells with recombinant virus particles. In this version of the assay, cells are infected with recombinant virus particles and fluorophore expression is monitored over time (FIG. 5). As with the genome plasmid version of the assay, it is not necessary to know the exact titer of the starting virus stock. Typically, a dilution series is used for initial infection, such as a dilution series ranging from 1:100 to 1:218,700, as shown in FIG. 5. A dilution of 1:100 generally leads to infection of all cells, whereas a dilution of 1:218,700 generally leads to initial infection of very few cells. In this example, a 96-well plate is used and 11 different virus constructs are tested simultaneously at eight different dilutions (1:100, 1:300, 1:900, 1:2700, 1:8100, 1:24,300, 1:72,900 and 1:218,700). The plate also includes four wells of mock-infected cells and four wells of FLUORESBRITE™ beads. Once the cells are infected, the plate is placed in a TECAN™ plate reader for continuous fluorescence monitoring. The data collected is used to calculate ln-slope for each construct (FIG. 8).

The TECAN™ plate readers also provide incubation functions (maintaining an appropriate temperature as well as $CO_2$ and $O_2$ levels). Data points are taken every 15 minutes to calculate the ln-slope. Using these methods, it is possible to rapidly and efficiently compare the kinetics between a number of different viruses and between different cell types. For example, to evaluate whether particular recombinant adenoviruses could be used therapeutically as oncolytic viruses, this assay could be employed to find viruses that exhibit high replication kinetics in tumor cells, but slow virus kinetics in non-tumor cells. Furthermore, the virus kinetics of the recombinant viruses can be evaluated by infecting or transfecting the tumor cell type of interest in this assay.

Calculating Log-Slope

To measure log-slope, the linear plot of fluorescence intensity versus time is converted to a semi-log plot by taking the natural logarithm of the measured fluorescence intensity at each time point. Since the fluorescence intensity exhibits exponential growth during viral replication, this conversion results in a straight line when plotting ln(fluorescence intensity) vs. time. This straight line is then fit using standard least-squares methods. The resulting slope produced by this fit is the ln-slope of the fluorescence vs. time and thus the ln-slope of the viral growth vs. time. Equations are shown below.

$$FI(t) = F_0 e^{\alpha(t-t_0)};$$

where FI is measured fluorescence intensity, t is time, $F_0$ is the initial fluorescence intensity at time=$t_0$, and $\alpha$ is the ln-slope.

Take natural logarithm of both sides:

$$\ln[FI(t)] = \ln[F_0 e^{\alpha(t-t_0)}] = \ln(F_0) + \alpha(t-t_0)$$

The right hand side is now a linear equation with a ln-slope of $\alpha$.

In view of the many possible embodiments to which the principles of the disclosure may be applied, it should be recognized that the illustrated embodiments are only examples of the disclosure and should not be taken as limiting the scope of the disclosure. Rather, the scope of the disclosure is defined by the following claims. We therefore claim all that comes within the scope and spirit of these claims.

---

SEQUENCE LISTING (21 sequences)

SEQ ID NO: 1 - DNA, 36791 bp, Artificial Sequence
  Synthetic adenovirus genome YPet-P2A-E1A
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatggtgagcaaaggcgaagagctgttcaccggcgtggtgcccatcctggtggagctggacggcgacgtgaacggccacaagttcagcgtgagcggcgagggcgagggcgacgccacctacggcaagctgaccctgaagctgctgtgcaccaccggcaagctgcccgtgccctggcccaccctggtgaccaccctgggctacggcgtgcagtgcttcgcccggtaccccgaccacatgaagcagcacgacttcttcaagagcgccatgcccgagggctacgtgcaggagcggaccatcttcttcaaggacgacggcaactacaagacccgggccgaggtgaagttcgagggcgacaccctggtgaaccggatcgagctgaagggcatcgacttcaaggaggacggcaacatcctgggccacaagctggagtacaactacaacagccacaacgtgtacatcaccgccgacaagcagaagaacggcatcaaggccaacttcaagatccggcacaacatcgaggacggcggcgtgcagctggccgaccactaccagcagaacacccccatcggcgacggccccgtgctgctgcccgacaaccactacctgagctaccagagcgccctgttcaaggaccccaacgagaagcgggaccacatggtgctgctggagttcctgaccgccgccggcatcaccgagggcatgaacgagctctataagggaagcggagctactaacttcagcctgctgaagcaggctggtgacgtcgaggagaatcctggcccaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgcccaacttttctatacaaagttgtaatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcataagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccatttcaactttgtatacaaaagttgtgatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaacgcaatagatgccatgaaccacccaactttccccgcgcccgctatgcttccactgcaacaagttgttgccggcggctttgtcccagccaatcagcctcgcccaccttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtacctcaactttgtataataaagttgtaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 2 - DNA, 36791 bp, Artificial Sequence
  Synthetic adenovirus genome E1A-P2A-YPet
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccaggaagcggagctactaacttcagcctgctgaagcaggctggtgacgtcgaggagaatcctggcccaatggtgagcaaaggcgaagagctgttcaccggcgtggtgcccatcctggtggagctggacggcgacgtgaacggccacaagttcagcgtgagcggcgagggcgagggcgacgccacctacggcaagctgaccctgaagctgctgtgcaccaccggcaagctgcccgtgccctggcccaccctggtgaccaccctgggctacggcgtgcagtgcttcgcccggtaccccgaccacatgaagcagcacgacttcttcaagagcgccatgcccgagggctacgtgcaggagcggaccatcttcttcaaggacgacggcaactacaagacccgggccgaggtgaagttcgagggcgacaccctggtgaaccggatcgagctgaagggcatcgacttcaaggaggacggcaacatcctgggccacaagctggagtacaactacaacagccacaacgtgtacatcaccgccgacaagcagaagaacggcatcaaggccaacttcaagatccggcacaacatcgaggacggcggcgtgcagctggccgaccactaccagcagaacacccccatcggcgacggccccgtgctgctgcccgacaaccactacctgagctaccagagcgccctgttcaaggaccccaacgagaagcgggaccacatggtgctgctggagttcctgaccgccgccggcatcaccgagggcatgaacgagctctataagtaaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgcccaacttttctatacaaagttgtaatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcataagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccatttcaactttgtatacaaaagttgtgatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaacgcaatagatgccatgaaccacccaactttccccgcgcccgctatgcttccactgcaacaagttgttgccggcggctttgtcccagccaatcagcctcgcccaccttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtacctcaactttgtataataaagttgtaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 3 - DNA, 36791 bp, Artificial Sequence
  Synthetic adenovirus genome E1B-55k-P2A-YPet
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagatggaagcggagctactaacttcagcctgctgaagcaggctggtgacgtcgaggagaatcctggcccaatggtgagcaaaggcgaagagctgttcaccggcgtggtgcccatcctggtggagctggacggcgacgtgaacggccacaagttcagcgtgagcggcgagggcgagggcgacgccacctacggcaagctgaccctgaagctgctgtgcaccaccggcaagctgcccgtgccctggcccaccctggtgaccaccctgggctacggcgtgcagtgcttcgcccggtaccccgaccacatgaagcagcacgacttcttcaagagcgccatgcccgagggctacgtgcaggagcggaccatcttcttcaaggacgacggcaactacaagacccgggccgaggtgaagttcgagggcgacaccctggtgaaccggatcgagctgaagggcatcgacttcaaggaggacggcaacatcctgggccacaagctggagtacaactacaacagccacaacgtgtacatcaccgccgacaagcagaagaacggcatcaaggccaacttcaagatccggcacaacatcgaggacggcggcgtgcagctggccgaccactaccagcagaacacccccatcggcgacggccccgtgctgctgcccgacaaccactacctgagctaccagagcgccctgttcaaggaccccaacgagaagcgggaccacatggtgctgctggagttcctgaccgccgccggcatcaccgagggcatgaacgagctctataagtgaggtactgaaatgtgtgggcgtggcttaagggtgggaaagaatatataaggtgggggtcttatgtagttttgtatctgttttgcagcagccgccgccgcccaacttttctatacaaagttgtaatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcataagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccatttcaactttgtatacaaaagttgtgatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaacgcaatagatgccatgaaccacccaactttccccgcgcccgctatgcttccactgcaacaagttgttgccggcggctttgtcccagccaatcagcctcgcccaccttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtacctcaactttgtataataaagttgtaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 4 - DNA, 36782 bp, Artificial Sequence
  Synthetic adenovirus genome E1B-55k-P2A-mCherry
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagatggaagcggagctactaacttcagcctgctgaagcaggctggtgacgtcgaggagaatcctggcccaatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtgaggtactgaaatgtgtgggcgtggcttaagggtgggaaagaatatataaggtgggggtcttatgtagttttgtatctgttttgcagcagccgccgccgcccaacttttctatacaaagttgtaatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcataagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccatttcaactttgtatacaaaagttgtgatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaacgcaatagatgccatgaaccacccaactttccccgcgcccgctatgcttccactgcaacaagttgttgccggcggctttgtcccagccaatcagcctcgcccaccttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtacctcaactttgtataataaagttgtaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 5 - DNA, 36794 bp, Artificial Sequence
  Synthetic adenovirus genome YPet-P2A-(DNA Poly)
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgcccaacttttctatacaaagttgtaatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcataagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaaaagcatgatgcaaaataaaaaactcaccaaggccattgggccaggattctcctcgacgtcaccagcctgcttcagcaggctgaagttagtagctccgcttcccttatagagctcgttcatgccctcggtgatgccggcggcggtcaggaactccagcagcaccatgtggtcccgcttctcgttggggtccttgaacagggcgctctggtagctcaggtagtggttgtcgggcagcagcacggggccgtcgccgatgggggtgttctgctggtagtggtcggccagctgcacgccgccgtcctcgatgttgtgccggatcttgaagttggccttgatgccgttcttctgcttgtcggcggtgatgtacacgttgtggctgttgtagttgtactccagcttgtggcccaggatgttgccgtcctccttgaagtcgatgcccttcagctcgatccggttcaccagggtgtcgccctcgaacttcacctcggcccgggtcttgtagttgccgtcgtccttgaagaagatggtccgctcctgcacgtagccctcgggcatggcgctcttgaagaagtcgtgctgcttcatgtggtcggggtaccgggcgaagcactgcacgccgtagcccagggtggtcaccagggtgggccagggcacgggcagcttgccggtggtgcacagcagcttcagggtcagcttgccgtaggtggcgtcgccctcgccctcgccgctcacgctgaacttgtggccgttcacgtcgccgtccagctccaccaggatgggcaccacgccggtgaacagctcttcgcctttgctcaccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccatttcaactttgtatacaaaagttgtgatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaacgcaatagatgccatgaaccacccaactttccccgcgcccgctatgcttccactgcaacaagttgttgccggcggctttgtcccagccaatcagcctcgcccaccttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcgaatcatttttcattcagtagtatagccccaccaccacatagcttatacagatcaccgtacctcaactttgtataataaagttgtaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 6 - DNA, 36785 bp, Artificial Sequence
  Synthetic adenovirus genome DBP-P2A-YPet
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgcccaacttttctatacaaagttgtaatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcataagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttacttatagagctcgttcatgccctcggtgatgccggcggcggtcaggaactccagcagcaccatgtggtcccgcttctcgttggggtccttgaacagggcgctctggtagctcaggtagtggttgtcgggcagcagcacggggccgtcgccgatgggggtgttctgctggtagtggtcggccagctgcacgccgccgtcctcgatgttgtgccggatcttgaagttggccttgatgccgttcttctgcttgtcggcggtgatgtacacgttgtggctgttgtagttgtactccagcttgtggcccaggatgttgccgtcctccttgaagtcgatgcccttcagctcgatccggttcaccagggtgtcgccctcgaacttcacctcggcccgggtcttgtagttgccgtcgtccttgaagaagatggtccgctcctgcacgtagccctcgggcatggcgctcttgaagaagtcgtgctgcttcatgtggtcggggtaccgggcgaagcactgcacgccgtagcccagggtggtcaccagggtgggccagggcacgggcagcttgccggtggtgcacagcagcttcagggtcagcttgccgtaggtggcgtcgccctcgccctcgccgctcacgctgaacttgtggccgttcacgtcgccgtccagctccaccaggatgggcaccacgccggtgaacagctcttcgcctttgctcaccattgggccaggattctcctcgacgtcaccagcctgcttcagcaggctgaagttagtagctccgcttccaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccatttcaactttgtatacaaaagttgtgatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaacgcaatagatgccatgaaccacccaactttccccgcgcccgctatgcttccactgcaacaagttgttgccggcggctttgtcccagccaatcagcctcgcccaccttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcgaatcatttttcattcagtagtatagccccaccaccacatagcttatacagatcaccgtacctcaactttgtataataaagttgtaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 7 - DNA, 36797 bp, Artificial Sequence
  Synthetic adenovirus genome YPet-P2A-ADP
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgcccaacttttctatacaaagttgtaatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcataagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccatttcaactttgtatacaaaagttgtgatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatggtgagcaaaggcgaagagctgttcaccggcgtggtgcccatcctggtggagctggacggcgacgtgaacggccacaagttcagcgtgagcggcgagggcgagggcgacgccacctacggcaagctgaccctgaagctgctgtgcaccaccggcaagctgcccgtgccctggcccaccctggtgaccaccctgggctacggcgtgcagtgcttcgcccggtaccccgaccacatgaagcagcacgacttcttcaagagcgccatgcccgagggctacgtgcaggagcggaccatcttcttcaaggacgacggcaactacaagacccgggccgaggtgaagttcgagggcgacaccctggtgaaccggatcgagctgaagggcatcgacttcaaggaggacggcaacatcctgggccacaagctggagtacaactacaacagccacaacgtgtacatcaccgccgacaagcagaagaacggcatcaaggccaacttcaagatccggcacaacatcgaggacggcggcgtgcagctggccgaccactaccagcagaacacccccatcggcgacggccccgtgctgctgcccgacaaccactacctgagctaccagagcgccctgttcaaggaccccaacgagaagcgggaccacatggtgctgctggagttcctgaccgccgccggcatcaccgagggcatgaacgagctctataagggaagcggagctactaacttcagcctgctgaagcaggctggtgacgtcgaggagaatcctggcccaatggtgatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaacgcaatagatgccatgaaccacccaactttccccgcgcccgctatgcttccactgcaacaagttgttgccggcggctttgtcccagccaatcagcctcgcccaccttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtacctcaactttgtataataaagttgtaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 8 - DNA, 36791 bp, Artificial Sequence
  Synthetic adenovirus genome ADP-P2A-YPet
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgcccaacttttctatacaaagttgtaatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcataagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccatttcaactttgtatacaaaagttgtgatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtaggaagcggagctactaacttcagcctgctgaagcaggctggtgacgtcgaggagaatcctggcccaatggtgagcaaaggcgaagagctgttcaccggcgtggtgcccatcctggtggagctggacggcgacgtgaacggccacaagttcagcgtgagcggcgagggcgagggcgacgccacctacggcaagctgaccctgaagctgctgtgcaccaccggcaagctgcccgtgccctggcccaccctggtgaccaccctgggctacggcgtgcagtgcttcgcccggtaccccgaccacatgaagcagcacgacttcttcaagagcgccatgcccgagggctacgtgcaggagcggaccatcttcttcaaggacgacggcaactacaagacccgggccgaggtgaagttcgagggcgacaccctggtgaaccggatcgagctgaagggcatcgacttcaaggaggacggcaacatcctgggccacaagctggagtacaactacaacagccacaacgtgtacatcaccgccgacaagcagaagaacggcatcaaggccaacttcaagatccggcacaacatcgaggacggcggcgtgcagctggccgaccactaccagcagaacacccccatcggcgacggccccgtgctgctgcccgacaaccactacctgagctaccagagcgccctgttcaaggaccccaacgagaagcgggaccacatggtgctgctggagttcctgaccgccgccggcatcaccgagggcatgaacgagctctataagtgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaacgcaatagatgccatgaaccacccaactttccccgcgcccgctatgcttccactgcaacaagttgttgccggcggctttgtcccagccaatcagcctcgcccaccttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcgaatcatttttcattcagtagtatagccccaccaccacatagcttatacagatcaccgtacctcaactttgtataataaagttgtaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 9 - DNA, 36720 bp, Artificial Sequence
  Synthetic adenovirus genome E3-14.7k-P2A-YPet
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcataagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccatttatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaacgcaatagatgccatgaaccacccaactttccccgcgcccgctatgcttccactgcaacaagttgttgccggcggctttgtcccagccaatcagcctcgcccaccttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaacggaagcggagctactaacttcagcctgctgaagcaggctggtgacgtcgaggagaatcctggcccaatggtgagcaaaggcgaagagctgttcaccggcgtggtgcccatcctggtggagctggacggcgacgtgaacggccacaagttcagcgtgagcggcgagggcgagggcgacgccacctacggcaagctgaccctgaagctgctgtgcaccaccggcaagctgcccgtgccctggcccaccctggtgaccaccctgggctacggcgtgcagtgcttcgcccggtaccccgaccacatgaagcagcacgacttcttcaagagcgccatgcccgagggctacgtgcaggagcggaccatcttcttcaaggacgacggcaactacaagacccgggccgaggtgaagttcgagggcgacaccctggtgaaccggatcgagctgaagggcatcgacttcaaggaggacggcaacatcctgggccacaagctggagtacaactacaacagccacaacgtgtacatcaccgccgacaagcagaagaacggcatcaaggccaacttcaagatccggcacaacatcgaggacggcggcgtgcagctggccgaccactaccagcagaacacccccatcggcgacggccccgtgctgctgcccgacaaccactacctgagctaccagagcgccctgttcaaggaccccaacgagaagcgggaccacatggtgctgctggagttcctgaccgccgccggcatcaccgagggcatgaacgagctctataagtaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcgaatcatttttcattcagtagtatagccccaccaccacatagcttatacagatcaccgtacctaaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 10 - DNA, 36790 bp, Artificial Sequence
  Synthetic adenovirus genome YPet-P2A-E4-ORF2
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgcccaacttttctatacaaagttgtaatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcataagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccatttcaactttgtatacaaaagttgtgatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaacgcaatagatgccatgaaccacccaactttccccgcgcccgctatgcttccactgcaacaagttgttgccggcggctttgtcccagccaatcagcctcgcccaccttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtacctcaactttgtataataaagttgaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacattgggccaggattctcctcgacgtcaccagcctgcttcagcaggctgaagttagtagctccgcttcccttatagagctcgttcatgccctcggtgatgccggcggcggtcaggaactccagcagcaccatgtggtcccgcttctcgttggggtccttgaacagggcgctctggtagctcaggtagtggttgtcgggcagcagcacggggccgtcgccgatgggggtgttctgctggtagtggtcggccagctgcacgccgccgtcctcgatgttgtgccggatcttgaagttggccttgatgccgttcttctgcttgtcggcggtgatgtacacgttgtggctgttgtagttgtactccagcttgtggcccaggatgttgccgtcctccttgaagtcgatgcccttcagctcgatccggttcaccagggtgtcgccctcgaacttcacctcggcccgggtcttgtagttgccgtcgtccttgaagaagatggtccgctcctgcacgtagccctcgggcatggcgctcttgaagaagtcgtgctgcttcatgtggtcggggtaccgggcgaagcactgcacgccgtagcccagggtggtcaccagggtgggccagggcacgggcagcttgccggtggtgcacagcagcttcagggtcagcttgccgtaggtggcgtcgccctcgccctcgccgctcacgctgaacttgtggccgttcacgtcgccgtccagctccaccaggatgggcaccacgccggtgaacagctcttcgcctttgctcaccatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 11 - DNA, 36781 bp, Artificial Sequence
  Synthetic adenovirus genome mCherry-P2A-E4-ORF2
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgcccaacttttctatacaaagttgtaatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcataagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccatttcaactttgtatacaaaagttgtgatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaacgcaatagatgccatgaaccacccaactttccccgcgcccgctatgcttccactgcaacaagttgttgccggcggctttgtcccagccaatcagcctcgcccaccttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtacctcaactttgtataataaagttgaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacattgggccaggattctcctcgacgtcaccagcctgcttcagcaggctgaagttagtagctccgcttcccttgtacagctcgtccatgccgccggtggagtggcggccctcggcgcgttcgtactgttccacgatggtgtagtcctcgttgtgggaggtgatgtccaacttgatgttgacgttgtaggcgccgggcagctgcacgggcttcttggccttgtaggtggtcttgacctcagcgtcgtagtggccgccgtccttcagcttcagcctctgcttgatctcgcccttcagggcgccgtcctcggggtacatccgctcggaggaggcctcccagcccatggtcttcttctgcattacggggccgtcggaggggaagttggtgccgcgcagcttcaccttgtagatgaactcgccgtcctgcagggaggagtcctgggtcacggtcaccacgccgccgtcctcgaagttcatcacgcgctcccacttgaagccctcggggaaggacagcttcaagtagtcggggatgtcggcggggtgcttcacgtaggccttggagccgtacatgaactgaggggacaggatgtcccaggcgaagggcagggggccacccttggtcaccttcagcttggcggtctgggtgccctcgtaggggcggccctcgccctcgccctcgatctcgaactcgtggccgttcacggagccctccatgtgcaccttgaagcgcatgaactccttgatgatggccatgttatcctcctcgcccttgctcaccatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 12 - protein, 19 aa, Artificial Sequence
  Synthetic peptide
ATNFSLLKQAGDVEENPGP

SEQ ID NO: 13 - protein, 22 aa, Artificial Sequence
  Synthetic peptide
VKQTLNFDLLKLAGDVESNPGP

SEQ ID NO: 14 - protein, 20 aa, Artificial Sequence
  Synthetic peptide
QCTNYALLKLAGDVESNPGP

SEQ ID NO: 15 - protein, 18 aa, Artificial Sequence
  Synthetic peptide
EGRGSLLTCGDVEENPGP

SEQ ID NO: 16 - protein, 22 aa, Artificial Sequence
  Synthetic peptide
GSGATNFSLLKQAGDVEENPGP

SEQ ID NO: 17 - protein, 25 aa, Artificial Sequence
  Synthetic peptide
GSGVKQTLNFDLLKLAGDVESNPGP

SEQ ID NO: 18 - protein, 23 aa, Artificial Sequence
  Synthetic peptide
GSGQCTNYALLKLAGDVESNPGP

SEQ ID NO: 19 - protein, 21 aa, Artificial Sequence
  Synthetic peptide
GSGEGRGSLLTCGDVEENPGP

SEQ ID NO: 20 - DNA, 35876 bp, Artificial Sequence
  Synthetic adenovirus genome Ad9 E3-15k-P2A-YPet
ctatctatataatataccccacaaagtaaacaaaagttaatatgcaaatgagcttttgaattttaacggtttcggggcggagccaacgctgattggacgagagaagacgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgatccgcagggtatttaaaccagtcgagtccgtcaagaggccactcttgagtgccagcgagtagagatttctctgagctccgctcccagagaccgagaaaaatgagacacctgcgcctcctgccttcaactgtgcccggtgagctggctgtgcttatgctggaggactttgtggatacagtattggaggacgaactgcatccaagtccgttcgagctgggacccacacttcaggatctctatgatctggaggtagatgcccatgatgacgaccctaacgaggaggctgtgaatttaatatttccagaatctatgattcttcaggctgacatagccaacgaatctactccacttcatacaccgactctgtcacccatacctgaattggaagaggaggacgaactagacctccggtgttatgaggaaggttttcctcccagcgattcagaggatgaacggggtgagcagaccatggctctgatctcagactatgcttgtgtgattgtggaggagcaagatgtgattgaaaaatctactgagccagtacaaggctgtaggaactgccagtaccaccgggataagtccggagatgtgaacgcctcctgcgctttgtgctatatgaaacagactttcagctttatttacagtaagtggagtgaatgtgagagaggctgagtgcttaacacataactgtaatgcttgaacagctgtgctaagtgtggtttattttgttactaggtccggtgtcagaggatgagttatcaccctcagaagaagaccacccgtctccccctgagctgtcaggcgaaacgcccctgcaagtgttcagacccaccccagtcagacccagtggcgagaggcgagcggctgttgacaaaattgaggacttgttgcaggacatgggtggggatgaacctttggacctgagcttgaaacgccccaggaactagacgcagctgcgcttagtcatgtgtaaataaagttgtacaataaaagtctatgtgacgcatgcaaggtgtggtttatgactcatgggcggggcttagtcctatataagtggcaacacctgggcacttgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataaagaggaatttgaaaatatttttgctgactgctctggcctgctagattctctgaatcttggccaccagtcccttttccaggaaagggtactccacagccttgatttttccagcccagggcgcactacagccggggttgcttttgtggtttttctggttgacaaatggagccaggacacccaactgagcaggggctacatcctggacttcgcagccatgcacctgtggagggcctggatcaggcagcggggacagagaatcttgaattactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagttaagagggagaggagcgatgggggtaataccgggatgatgaccgagctgacggccagcctgatgaatcggaagcgcccagagcgccttacctggtacgagctacagcaggagtgcagggatgagttgggcctgatgcaggataaatatggcctggagcagataaaaacccattggttgaacccagatgaggattgggaggaggctattaagaagtatgccaagatagccctgcgcccagattgcaagtacatagtgaccaagaccgtgaatatcagacatgcctgctacatctcggggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttcttcggcttcaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacactgctcttccctggagacgggctgcttctgcctggtgaagggcacagcctctctgaagcataatatggtgaagggctgcacggatgagcgcatgtacaacatgctgacctgcgattcgggggtctgccatatcctgaagaacatccatgtgacctcccaccccagaaagaagtggccagtgtttgagaataacctgctgatcaagtgccatatgcacctgggagccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtcgagtgagtagtgggcgtggctaaggtgactataaaggcgggtgtcttacgagggtctttttgcttttctgcagacatcatgaacgggaccggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggagctcgtcgctcgacagcaccgccgcagccgcggcagccgcagctgccatgacagcgacgagactggcctcgagctacatgcccagcagcggcagcagcccctctgtgcccagttccatcatcgccgaggagaaactgctggccctgctggccgagctggaagccctgagccgccagctggccgccctgacccagcaggtgtccgagctccgcgagcagcaacagcagcaaaataaatgaaaacttcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtctttgagaaggagactgatggccacggggagccccttggtgtaggtattggcgaagcggttgagctgggagggatgcatgcggggggagatgatgtgcagtttggcctggatcttgaggttggcgatgttgccacccagatcccgccgggggttcatgttgtgcaggaccaccaggacggtgtagcccgtgcacttggggaacttgtcatgcaacttggaagggaatgcgtggaagaatttggagacgcccttgtgcccgcccaggttttccatgcattcatccatgatgatggcgatgggcccgtgggctgcggctttggcaaagacgtttctggggtcagatacatcataattatgctcctgggtgagatcatcataagacattttaatgaatttggggcggagggtgccagattgggggacgatggttccctcgggccccggggcgaagttcccctcacagatctgcatctcccaggctttcatctcggagggggggatcatgtccacctgcggggcgatgaaaaaaacggtttccggggctggggtgatgagctgcgaagagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctgacttggaggttttcccgaacgagctcgccgaggaggcggtccccgcccagcgagaggagctcttgcagggaagcaaagtttttcaggggcttgagtccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgagtgagggtggtctccgtcacggtgaaggggtgggcccctggctgggcgcttgcaagggtgcgcttgagactcatcctgctggtgctgaaacgggcacggtcttcgccctgcgagtcggcgagatagcagttgaccatgagctcgtagttgagggcctcggcggcgtggcccttggcgcggagcttgcccttggaagagcgcccgcaggcgggacagaggagggattgcagggcgtagagcttgggggcgagaaagacggactcgggagcgaaagcgtccgctccgcagtgggcgcagacggtctcgcactcgacgagccaggtgagctctggctgctcggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccactagggggtccaccttttccaccgtgtgcagacacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcttgccctgccgcgatgctttttaggagactttcatccatctggtcagaaaagactatttttttattgtcaagcttggtggcgaaggagccatagagggcgttggatagaagcttggcgatggatctcatggtctgatttttgtcacggtcggcgcgctccttggccgcgatgtttagctggacatactcgcgcgcgacgcacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcatccaaggccatctgccactcgcgggcggccagcgctcgctcgtaggggttgaggggcggaccccagggcatgggatgagtgagggcggaggcgtacatgccgcagatgtcgtagacatagatgggctccgagaggatgccgatgtaggtgggataacagcgccccccgcggatgctggcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtggggcaagcggaccgagtcgcggatgaagtgcgcgtaggagtcttgcagcttggcgacgagctcggcggtgacgaggacgtccatggcgcagtagtccagcgtttcgcggatgatgtcataacccgcctctcctttcttctcccacagctcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtgtccctgaccatgactttcaagaactggtacttgaaatccgagtcgtcgcagccgccgtgctcccagagctcgaaatcggtgcgcttcttcgagagggggttaggcagagcgaaagtgacgtcattgaagagaatcttgcctgctcgcggcatgaaattgcgggtgatgcggaaagggcccgggacggaggctcggttgttgatcacctgggcggcaaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctctagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcgggttcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggctttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggtcgtgtccacgcattgcatgagcccgtagctgcgcggggccacgaccgtgccgcggtgcgcttttagaagcggtgtcgcgggcgtgctcccggcggcagcggcggttctggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggtcatgaactgttcgatctcctcctcctggagatcgccgcggcccgcgcgctccacggtggcggcgaggtcattggagatgcggcccatgagctgcgagaaggcgcccaggccgctctcgttccagacgcggctgtagaccacgtccccgtcggcgtcgcgtgcgcgcatgaccacctgcgcgaggttgagctccacgtgccgcgtgaagacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcctcgtagaaatccacggcgaagttgaaaaactgggcattgcgggccgagaccgtgagctcgtcttccaggagccggatgagctcggcgatggtggcgcgcacctcgcgctcgaaatccccgggggcctcctcttcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcgatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacaaagcggtggtaggccccggtgttgatggtgtaggtgcagttggccatgagcgaccagttgacggtctgcaggccgggttgcacgacctcggagtacctgagccgcgagaaggcgcgcgagtcgaagacgtagtcattgcaggtgcgcacgaggtactggtagccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtccccttgaatcaggctggagccgcgactaacgtggtattggcactcccgtctcgacccgagcccgatagccgccaggatacggcggagagtcctttttgccggccaaggggggtcgctagacttgaaagcgaccgaaaaccctgccgggtagtggctcgcgcccgtagtctggagaagcatcgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgctcacgtggcggcggccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcactgctgaacatcgccgagcccgagggtcgctggctgctggagctgatcaacatcttgcagagcatcgtagtgcaggagcgcagcctgagcttggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctaagcgaccgcgagctgatgctgagcctgcgccgggcgctggtagggggcgctgccggcggcgaggagtcctacttcgacatgggggcggacctgcattggcagccgagccggcgcgccttggaggccgcctacggtccagaggacttggatgaggaagaggaagaggaggaggatgcacccgctgcggggtactgacgcctccgtgatgtgtttttagatgcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggttccccagagcgaggtgtaccagtcgggcccggactactttttccagacgagccggcagggcttgcagacggtgaacctgagccaggctttcaagaacctgcgagggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaacttcttgctgaccaatagacagcagaagatcccggcgcaatatgcgctgtcggccgaggaggaaaggatcctgagatatgtgcagcagagcgtagggctgttcctgatgcaggagggggccacccccagcgccgcgctggacatgaccgcgcgcaacatggaacctagcatgtacgccgccaaccggccgttcatcaataagctgatggactacctgcaccgcgcggcggtcatgaacacggactactttacaaacgccatcctgaacccgcactggctcccgccgccggggttctacacgggcgagtacgacatgcccgaccccaacgacgggttcctgtgggacgacgtggacagcgtggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgttggaagacctacgctcaggaccatagggatgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtggctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcaaaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggctacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgtcacctgcggcgcggagcaagtctactggtcgctgccggacctcatgcaagacccagtcaccttccgctctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcttacaagcgcgggcggacttccaccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcagtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccactgctaccgtctccacttctaccgccgccacggctaccgagcctcccaggaggcgaagatggggcgccgccagccggctgatgcccaactacgtggtgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaattcgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgctaagggaaaagctcaaagaccagaactttcagcagaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaaaggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcagctcccgcggtcgtgcaggcccccccggtggcgaccgccgtgcgccgcgtccccgcccgccgccaggcccagaactggcagagcacgttgcacagtatcgtaggcctgggagtgaaaagtctgaagcgccgccgatgctattgaaagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacagcttacaacagtctggcccccaagggtgcccccaactccagccagtggcttgcaaaagacaccaatgctggcgatcaagcattaaaaacccacacacatggcgtagctgctatggggggaacagatatcacagcaaagggtttgcaaattggtgttgacacgactgaaaacaagaatgagcctatttatgcaaatgaaatataccagccagaacctcaggtaggagaggaaaacttgcaagatgttgaaaacttttatggaggcagagctcttaaaaaagaaaccaaaatgaaaccttgctatggctcgtttgccagacccacaaatgaaaaaggcggtcaagccaaatttttaactgacggcgatggtcagctaactaaaaatcatgatatcacaatgaatttctttgacactcctggaggaacagttggtcaggatactgaacttgaagcagacattgttatgtatgctgagaatgtgcatctggaaactccagacacgcatgtggtgtacaaaccaggaacttctgatgagagttcagaagcaaatttggttcagcagtccatgccaaacaggcccaactacatcggcttcagggacaactttgtgggtctcatgtactataacagcactggcaacatgggtgtgctggctggtcaagcatctcagttgaatgctgtggtcgacttgcaagacagaaacacagagctgtcttaccagctcttgctagattctctgggtgacagaaccagatactttagcatgtggaactctgcagtggacagttatgatcctgatgtcaggattattgaaaatcacggtgtggaagatgaacttccaaactattgcttcccattggatggagctggcactaatgctacctaccaaggtgtaaaagttaaaaatggccaagatggagatgtaaacgcagattgggaaaaagatccaaatcttgcttcacgaaaccaaatatgcaagggtaacatcttcgccatggagatcaacctccaggccaacctgtggaagagttttctgtactcgaatgtggccctgtacctgcccgactcatacaagtacacgccggccaacgtcacgctgcccgccaataccaacacctacgagtacatgaacggccgcgtggtagccccctcgctggtggacgcctacatcaacatcggcgcccggtggtcgctggaccccatggacaacgtcaacccattcaaccaccaccgcaacgcgggcctgcgttaccgctccatgcttctgggcaacggccgctacgtgcccttccacatccaagtgccccaaaagttctttgccatcaagaacctgctcctgctccccggctcctacacctacgagtggaacttccgcaaggatgtcaacatgatcctgcagagttccctcggaaacgacctgcgcgtcgacggcgcctccgtccgcttcgacagcgtcaacctctacgccacattcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaagaaactccctccctcggctcgggtttcgatccctactttgtatactcgggttccatcccctacctcgacgggaccttctacctcaaccacaccttcaagaaggtctccatcatgttcgactcctcggtcagctggcccggcaacgaccggctgctcacgccgaacgagttcgagatcaagcgcagtgtcgacggggagggctacaatgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctaccttgcacccaccatgcgtcaggggcagccctaccccgccaacttcccctatcctctcatcggccagacagccgtgccctctgtcacccagaaaaagttcctctgcgacagggtcatgtggcgcatccccttctccagcaacttcatgtccatgggcgccctcaccgacctgggtcagaacatgctctatgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggcttcctcgccggcgacaagctggcctgcgccattgtcaacacggccggccgcgagaccggaggcgtgcactggctcgccttcggctggaacccgcgctcgcgcacctgctacatgttcgacccatttgggttctcggaccgccggctcaagcagatttacagcttcgagtacgaggctatgttgcgccgaagcgccctggcttcctcgcccgaccgctgtctcagcctcgagcagtccacccagaccgtgcaggggcccgactccgccgcctgcggacttttctgttgcatgttcttgcatgccttcgtgcactggcccgaccgacccatggacgggaaccccaccatgaacttgctgacgggggtgcccaacggcatgctacaatcgccacaggtgctgcccaccctccggcgcaaccaggaggagctctaccgcttcctcgcgcgccactccccttactttcgctcccaccgcgccgccatcgaacacgccaccgcttttgacaaaatgaaacaactgcgtgtatctcaataaacagcacttttattttacatgtactggagtatatgcaagttatttaaaagtcgaaggggttctcgcgctcgtcgttgtgcgccgcgctggggagggccacgttgcggtactggaacttgggctgccacttgaactcggggatcaccagtttgggcactggggtctcggggaaggtctcgctccacatgcgccggctcatctgcagggcgcccagtatgtccggggcggagatcttgaaatcgcagttggggccggtgctctgcgcgcgcgagttgcggtacacggggttgcagcactggaacaccatcagactggggtacttcacactggccagcacgctcttgtcgctgatctgatccttgtccaggtcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacaaaggccgagatctgcttgaaagcttgctgggccttggccccctcgctgaaaaacaggccgcagctcttcccgctgaactggttattcccgcacccggcatcatgcacgcagcagcgcgcgtcatggctggtcagttgcaccacgctccgtccccagcggttctgggtcaccttggccttgctaggctgctccttcaacgcgcgctggccgttctcgctggtcacatccatctccaccacgtggtccttgtggatcatcaccgtcccgtgcaaacacttgagctggccttccacctcggtgcagccgtgatcccacagggcgcagccggtgcactcccaattcttgtgtgcgatcccgctgtggctgaagatgtaaccttgcaacaggcgacccatgacggtgctaaatgatttactggtgctgaaggtcagttgcagaccgcgggcctcctcgttcatccaggtctggcacatcttttggaagatctcggtctgctcgggcatgagcttgtaagcatcgcgcaggccgctgtcgacgcggtagcgttccataagcacgttcatggtatccatgcccttctcccaggacgagaccagaggcagactcagggggttgcgcacgttcagaataccgggggtcgcgggctcgacgatgcgttttccgtccttgccttccttcaacagaaccggcggctggctgaatcccactcccacgatcacggcatcttcctggggcatctcttcgtcggggtctaccttggtcacatgcttggtctttctggcttgcttcttttttggagggctgtccacggggaccacgtcctcctcggaagacccggagcccacccgctgatactttcggcgcttggtgggcagaggaggtggaggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacttgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgttttcgcggtccccgaggcccttgccacctatcacatttttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagctcacccactttgcctaccccgccgtcaacctcccgcccaaggtcatgcgtcacatcatggatcagctcatcatgccccacatcgaagccctcgatgaaagtcaggagcagcgccccgaggacgcccgacccgtggtcagcgacgagatgctcgcgcgctggctcgggacccgcgagccccaggctttggaacagcggcgcaagctcatgctggccgtggtcctggtcaccctcgagctcgaatgcatgcgccgcttcttcagcgaccccgagaccctgcgcaaagtcgaggagaccctgcactacactttcagacacggtttcgtcaggcaggcctgcaagatttccaacgtggagctgaccaacctggtctcctgcctggggatcctgcatgagaaccgcctgggacagaccgtactccactctaccctgaagggcgaggcgcggagggactatgtccgcgactgcgtctttctctttctctgccacacatggcaagcagccatgggcgtgtggcagcagtgtctcgaggacgagaacctgaaggagctggacaagcttcttgctagaaaccttaaaaagctttggacgggcttcgacgagcgcaccgtcgcctcggacctggccgagatcgtcttccccgagcgcctgaggcagacgctgaaaggcgggctgcccgacttcatgagccagagcatgttgcaaaactaccgcactttcattctcgagcgatcggggatgctgcccgccacctgcaacgctttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctccttagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcggccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacacgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccggcggtcacggatacaacctccgcagctccggccaagcctcctcgtagatgggatcgagtgaagggcgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtaagagaagtcgccggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccttaatgagcaaggagattcccaccccttacatgtggagctatcagccccagatgggcctggccgcgggcgcctcccaagactactccacacgcatgaactggctcagtgccggcccctcgatgatatcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctgaccttgcagagcagctcttcggagcctcgctcgggaggcatcggaaccctccagttcgtggaggagtttgtgccctcggtctacttcaaccccttctcgggatcgccaggcctctacccggacgagttcataccgaacttcgacgcagtgagagaagcggtggacggctacgactgaatgtcccatggtgactctgctgagctcgctcggttgaggcatctggaccactgccgccgcctgcgctgcttcgcccgggagagctgcggactcatctactttgagtttcccgaggagcaccccaacggtcctgcacacggagtgcggatcaccgtagagggcaccaccgagtctcacctggtcaggttcttcacccagcaacccttcctggtcgagcgggaccggggcgccaccacctacaccgtctactgcatctgtccgaccccgaagttgcatgagaatttttgctgtactctttgtggtgagtttaataaaagctaaactcttgcaatactctggaccttgtcgtcatcaactcaacgagaccgtctacctcaccaaccagactgaggtaaaactcacctgcagaccacacaagacctatatcatctggttcttcgagaacacctcatttgcagtctcaaacactcactgcaacgacggtgttgaacttccaaacaacctttccagtggactgagttacgatacacatagagctaagctcgtcctctacaatcctttcgtagagggaacctaccactgccagagcggaccttgcttccacagttttactttggtgaacgttaccggcagcagcacagccgctccagaacctaaccttccttctgatactatcaaacctcgtttcggaggtgagctaaggcttcccccttctgaggagggggttagcccatacgaagtggtcgggtatttgattttaggggtggtcctgggtgggtgcatagcggtgctagctcagctgccttgctgggtagaaatcaaaatctttatatgctgggtcagacattgtggggaggaactatgaaggggctcttgctgattatcctttccctggtggggggtgtgctgtcatgccacgaacagccacgatgtaacatcaccacaggcaatgagaggagtgtcatatgcacagtagtcatcaaatgcgagcatgaatgccctctcaacatcacattcaaaaaccgtaccatggggaatgcatgggtgggcgactgggaaccaggagatgagcagaactacacggtcactgtccatggtagcgatggaaatcacactttcggtttcaaattcatttttgaagtcatgtgtgatatcacactgcatgtggctagacttcatggcttgtggccccctaccaaggaaaacatggttgggttttctttggcttttgtgatcatggcctgctttatgtcaggtctgctggtaggagctctagtgtggttcctgaaacgcaagcccaggtatggaaatgaggagaaggaaaaattgctataaattctttttcttttcacagcaccatgaatactttgaccagtgtcgtgctgctctctcttcttgtagcttttagtcaggcaggaattattaacttaaatgtatcatggggaatgaatctaactttagtgggaccctcagacctgccagttacatggtatgatggaaagggaatgcagttttgtgatggaaatacaattaagaacccacaaatcaagcatagctgtaatcaacagaatctaactttacttaatgctgacaagtctcatgaaagaacttacctaggttacagacatgacagtaagggaaaagtagactataaggttacagtcataccacctcctccagccactcgcaagcctttgtcagagcctcattatgttactgtgactatgggcgataacataactttagtgggaccctcagacctgccagttacatggtatgatggagaaggaaataaattctgcgatggagaaaaagttgaacatgcagaatttaatcatacatgtaacatccagaacctgacactgctctttgtcaacttaacgcataatggagcatacattggttataacaaagacggttctgatagagaattatatgaggtgtcagtcaaaaccttgtttcagaacggggctggacaaagtaaggttgaacaaggtaataaagggaaacctaatactgctcaaagtggtggtaaaaaaaccaaaacagaacatagaaaccagagtccaaaaagaaaatcaacaaataaccttcagccaacacaattgtatgttaggccttttactaatgttagtttaactggacctccaaatggcaaggttacttggtatgatggcgaacttaatgatccatgtgaacaaaagtacaaactcagaactttttgcaatcagcaaaatctaactttaattaatgtaagcagcacttatgatggcatctattatggcactgatgaaaaagataaggcaaatcgttacagaataaaagtaaatactacaaatcacaaaactgttaaaattaagccacataccagagaacctcctgctgtacaagaaaaacagtttgaattacaagatgcagaaactgatgaaaacgaatcaaaaattccctcagctactgtggcaatcgtggtgggagtgattgcgggctttgtaactctgatcattgtcttcatatgctacatctgctgccgcaagcgtcccaggtcatacaatcatatggtagacccactactcagcttctcttactgaaactcagtcactctcatttcagaaccatgaaggctttcacagcttgcgttctgattagcatagtcacacttagttcagctgcaatgattaatgttaatgtcactagaggtggtaaaattacattgaatgggacttatccacaaactacatggacaagatatcataaagatggatggaaaaatatctgtgaatggaatgttactgcatataaatgcttcaataatggaagcattactattactgccactgccaacattacttctggcacatacaaagctgaaagctataaaaatgaaatcaaaaaactaacctataaaaacaacaaaaccacatttgaagattctggaaattatgaacatcaaaaattatctttttatatgttgacaataattgaactgcctacaactaaggctcccaccacaaccagtacaactattaagaccactactcacactacagtgcaaaatactactttattgattgggtttttactgagagagaatgaaagtactactgaacagacagaggctacctcaagtgccttcagcagcactgcaaatttaacttcgcttgcttggactaatgaaaccggagtatcattgatgcatggccagccttactcaggtttggatattcaaattacttttctggttgtctgtgggatctttattcttgtggttcttctgtactttgtctgctgcaaagccagagagaaatctaggaggcccatctacaggccagtgattggggaacctcagccactccaagtggatggaggcttaaggaatcttctcttctcttttacagtatggtgatcagccatgattcctaggttcttcctatttaacatcctcttttgtctcttcaacatctgtgctgccttcgcggccgtctcgcacgcctcgcccgactgtctagggcctttccccacctacctcctctttgccctgctcacctgcacctgcgtctgcagcattgtctgcgtggtcatcaccttcctgcagctcatcgactggtgctgcgcgcgctataattatctccaccacagtcccgaatacagggacgagaacgtagccagaatcttaaggctcatctgaccatgcagactctgctcatgctgctatccctcctatcccctgccctcgccacttctgctgactctaaatgcaaattcgcggagatatggaatttcttagattgctatcaggagaaaattgatatgccctcctattacttggtgattgtgggaatagtcatggtctgctcctgcactttctttgccatcatgatctacccctgttttgatctcggctggaactctgttgaggcattcacatacacactagaaagcagttcactagcctccacgccaccgcccacaccgcctccccgcagaaatcagttcccactgattcagtacttagaagagccccctccccggcccccttccactgttagctactttcacataaccggcggcgatgactgaccaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgccttgtcaaacaggcaaagatcacctacgagctcgtgtccggcggcaagcagcatcgcctcacctatgagctgccccagcagaagcagaagttcacctgcatggtgggcgtcaaccccatagtcatcacccagcagtcgggcgagaccaacggctgcatccactgctcctgcgaaagccccgagtgcatatactccctcctcaagaccctttgcggactccgcgacctcctccccatgaacggaagcggagctactaacttcagcctgctgaagcaggctggtgacgtcgaggagaatcctggcccaatggtgagcaaaggcgaagagctgttcaccggcgtggtgcccatcctggtggagctggacggcgacgtgaacggccacaagttcagcgtgagcggcgagggcgagggcgacgccacctacggcaagctgaccctgaagctgctgtgcaccaccggcaagctgcccgtgccctggcccaccctggtgaccaccctgggctacggcgtgcagtgcttcgcccggtaccccgaccacatgaagcagcacgacttcttcaagagcgccatgcccgagggctacgtgcaggagcggaccatcttcttcaaggacgacggcaactacaagacccgggccgaggtgaagttcgagggcgacaccctggtgaaccggatcgagctgaagggcatcgacttcaaggaggacggcaacatcctgggccacaagctggagtacaactacaacagccacaacgtgtacatcaccgccgacaagcagaagaacggcatcaaggccaacttcaagatccggcacaacatcgaggacggcggcgtgcagctggccgaccactaccagcagaacacccccatcggcgacggccccgtgctgctgcccgacaaccactacctgagctaccagagcgccctgttcaaggaccccaacgagaagcgggaccacatggtgctgctggagttcctgaccgccgccggcatcaccgagggcatgaacgagctctataagtgatgttgattaaaagcacgaaaaccaatcagacccttcccccatttccccattcccaattactcataaaataaatcattggaattaatcattcaataaaaatcacttacttgaaatctgaaagtatgtctctggtgtagttgttcagcagcacctcgttaccctcctcccagctctggtattccagtccccggcgggcggcgaacttcctccacaccttgaaagggatgtcaaattcctggtccacaattttcattgtcttccctctcagatgtcaaagaggctccgggtggaagatgacttcaaccccgtctacccctatggctacgcgcggaatcagaatatccccttcctcactcccccctttgtctcctccgatggattccaaaacttcccccctggggtcctgtcactcaaactggctgacccaatagccatcgtcaatgggaatgtctcactcaaagtgggagggggtctcactttgcaagatggaactggaaaactaacagtcaatgctgatccacctttgcaacttacaaacaacaaattagggattgctttggacgctccatttgatgttatagacaataaactcacattgttagcgggccatggcttgtctattataacaaaagaaacatcaacactgcctggcttgattaatactcttgtagtattaactggaaagggtattggaacagaatcaacagataatggcggaagcgtatgtgttagagttggagaaggtggcggcttatcatttaataatgatggagacttggtagcatttaataaaaaagaagataagcgcaccctatggacaactccagacacatctccaaattgcaagattgatcaagataaggactctaagttaactctggtccttacaaagtgtggaagtcaaatattggctaatgtgtcattaattgtcgtagctggtaagtacaaaattatcaataacaatactcaaccagctctcaaaggatttaccattaaattattgtttgatgaaaatggagtacttatggaatcttcaaatcttggtaaatcatattggaactttagaaatgaaaattcaattatgtcaacagcttatgaaaaagctattggattcatgcctaatttggtagcctatccaaaacctaccgctggctctaaaaaatatgcaagagatatagtttatggaaacatctaccttggtggaaagccagatcaaccagtaaccattaaaactacctttaatcaggaaactggatgtgaatattctatcacatttgattttagttgggccaagacttatgtaaatgttgaatttgaaacaacctcttttaccttttcctatatcgcccaagaatgaaagaccaataaacgtgtttttcatttcaaaattttaatcatgtatctttattgatttttacaccagcacgggtagtcagtctcccaccaccagcccatttcacagtgtacactgttctctcagcacgggtggccttaaatagggaaatgttctcattagtgcgggaactggacttggggtctataatccacacagtttcctggcgagccaaacgggggtcggtgattgagatgaagccgtcctctgaaaagtcatccaagcgagcctcacagtccaaggtcacagtctggtggaatgagaagaacgcacagattcatactcggaaaacaggatgggtctgtgcctctccatcagcgccctcagcagtctctgccgccggggctcggtgcggctgctgcagattggatcgggatcgcaagtctctctgactataatccccacagccttcagcatcagtctcctggtgcgtcgggcacagcaccgcatcctgatctctgccatgttctcacagtaagtgcagcacataatcaccatgttattcagcagcccataattcagggcgctccagccaaagctcatgttggggatgatggaacccacgtgaccatcgtaccagatgcggcagtatatcaggtgcctgcccctcataaacacactgcccatatacatgatctctttgggcatgtttctgttcacaatctgacggtaccaggggaagcgctggttgaacatgcacccgtaaatgactctcctgaaccacacggccagcagggtgcctcccgcccgacactgcagggagcccggggatgaacagtggcaatgcaggatccagcgctcgtacccgctcaccatctgagctctcaccaagtccagggtagcagggcacaggcacactgacatacatctttttaaaatttttatttcctctggggtcaggatcatatcccaggggactggaaactcttggagcagggtaaagccagcagcacatggtaatccacggacagaacttacattatgataatctgcatgatcacaatcgggcaacaggggatgttgttcagtcagtgaagccctggtttcctcatcagatcgtggtaaacgggccctgcgatatggatgatggcggagcgagctggattgaatctcggtttgcattgtagtggattctcttgcgtaccttgtcgtacttctgccagcagaaatgggcccttgaacagcagatacccctcctgcggccgtcctttcgctgctgccgctcagtcatccaactgaagtacatccattctcgaagattctggagaagttcctctgcatctgatgaaataaaaaacccgtccatgcgaattcccctcatcacatcagccaggactctgtaggccatccccatccagttaatgctgccttgtctatcattcagagggggcggtggcaggattggaagaaccatttttattccaaacggtctcgaaggacgataaagtgcaagtcacgcaggtgacagcgttcccctccgctgtgctggtggaaacagacagccaggtcaaaacccactctattttcaaggtgctcgaccgtggcttcgagcagtggctctacgcgtacatccagcataagaatcacattaaaggctggccctccatcgatttcatcaatcatcaggttacattcctgcaccatccccaggtaattctcatttttccagccttgaattatctctacaaattgttggtgtaagtccactccgcacatgtggaaaagctcccacagtgccccctccactttcataatcaggcagaccttcataatagaaacagatcctgctgctccaccacctgcagcgtgttcaaaacaacaagattcaataaggttctgccctccgccctgagctcgcgcctcaatgtcagctgcaaaaagtcacttaagtcctgggccactacagctgacaattcagagccagggctaagcgtgggactggcaagcgtaagggaaaactttaatgctccaaagctagcacccaaaaactgcatgctggaataagctctctttgtgtctccggtgatgccttccaaaatgtgagtgataaagcgtggtagtttttctttaatcatttgcgtaatagaaaagtcctctaaataagtcactaggaccccagggaccacaatgtggtagcttacaccgcgtcgctgaagcatggttagtagagatgagagtctgaaaaacagaaagcatgcactaaactaaggtggctatttttactgaaggaaaaatcactctctccagcaacagggtacccactgggtggcccttgcggacatacaaaaatcggtccgtgtgattaaaaagcagcacagtaagttcctgtcttcttccggcaaaaatcacatcggactgggttagtatgtccctggcatggtagtcattcaaggccataaatctgccctgatatccagtaggaaccagcacactcacttttaggtgaagcaataccaccccatgcggaggaatgtggaaagattcagggcaaaagaaggtatatctattgctagtcccttcctggacgggagcgatccctccaggactatctatgaaagcatacagagattcagccatagctcagcccgcttaccagtagacagagagcacagcagtacaagcgccaacagcagcgactgactacccactaacccagctccctatttaaaggcaccttacactgacgtaatgaccaaaggtctaaaaaccccgccaaaaaaacacacacgccctgggtgttttttcgcgaaaacacttccgcgttctcacttcctcgtatcgatttcgtgactcaacttccgggttcccacgttacgtcacttctgcccttacatgtaactcagtcgtagggcgccatgttgcccacgtccaaaatggtttccatgtccagccacgcctccgcggcgaccgttagccgtgcgtcgtgacgtcatttgcatcgtcttctctcgtccaatcagcgttggctccgccccgaaaccgttaaaattcaaaagctcatttgcatattaacttttgtttactttgtggggtatattatatagatag

SEQ ID NO: 21 - DNA, 35563 bp, Artificial Sequence
  Synthetic adenovirus genome Ad34 E3-14.8k-P2A-YPet
catcatcaataatataccttatagatggaatggtgccaatatgtaaatgaggtgattttaaaaattgtggggtgtgtggtgattggctgtggggttaacggctaaacggggcggcgcggccgtgggaaaatgacgttttgtgggggtggagtttttttgcaagttgtcgcgggaaatgtgacgcataaaaaggctttttttctcacggaactactgacttttcccacggtatttaacaggaaatgaggtagttttgaccggatgcaagtgaaaattgctgatttgcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctacggtatttatacctcagggtttgtgtcaagaggccactcttgagtgccagcgagaagagttttctcctctgcgccggcagtttaataataaaaaaatgagagatttgcgatttctgcctcaggaaataatttctgctgagactggaaatgaaatactggagcttgtggtgcacgccctgatgggagacgatccggagccacctgtgcagctttttgagcctcctacgcttcaggaactgtatgatttagaggtagagggatcggaggattctaatgaggaagctgtgaatggcttttttaccgattctatgcttttagctgctaatgaaggattagaattagatccgcctttggacactttcgatactccaggggtgattgtggaaagcggtacaggtgtaagaaaattacctgatttgggttccgtggactgtgatttgcactgctatgaagacgggtttcctccgagtgatgaggaggaccatgaaaaggagcagtctatgcagactgcagcgggtgagggagtgaaggctgccagtgttggttttcagttggattgcccggagcttcctggacatggctgtaagtcttgtgaatttcacaggaaaaatactggagtaaaggaactgttatgttcgctttgttatatgagagcgcactgccactttatttacagtaagtgtgtttaagttaaaatttaaaggaatatgctgtttttcacatgtatattgagtgggagttttgtgcttcttattataggtcctgtgtctgatgctgatgagtcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacggccaagacaataagtgttccatatccgtgtttacttaaggtgacgtcaatatttgtgtgagagtgcaatgtaataaaaatatgttaactgttcactggtttttattgctttttgggcggggactcaggtatataagtagaagcagacctgtatggttagctcataggagctggctttcatccatggaggtttgggccattttggaagaccttagaaagactaggcaactgttagaggacgcttcggacggagtctccggtttttggagattctggttcgctagtgaattagctagggtagtttttaggataaaacaggactataaagaagaatttgaaaagttgttggtagattgcccaggactttttgaagctcttaatttgggccatcaagttcactttaaagaaaaagttttatcagttttagacttttcaaccccaggtagaactgccgctgctgtggcttttcttacttttatattagataaatggatcccgcagactcatttcagcaggggatacgttttggatttcgtagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggtccagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggagtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatattccaaagatgtaacctgggcattctgaatgaaggcgaagcaagggtccgccactgcgcttctacagatactggatgttttattttaattaagggcaatgccagcgtaaagcataacatgatttgcggtgcttccgatgagaggccttatcaaatgctcacttgtgccggtgggcattgtaatatgctggctactgtgcatattgtttcccatcaacgcaaaaaatggcctgtttttgatcacaatgtgttgaccaagtgtaccatgcatgcaggtgggcgtagaggaatgtttatgccttaccagtgtaacatgaatcatgtgaaagtgttgttggaaccagatgccttttccagaatgagcctaacaggaatctttgacatgaacatgcaaatctggaagatcctgaggtatgatgatacgagatcgagggtgcgcgcatgcgaatgcggaggcaagcatgccaggttccagccggtgtgtgtagatgtgactgaagatctgagaccggatcatttggttattgcccgcactggagcagagttcggatccagtggagaagaaactgactaaggtgagtattgggaaaacttggggtggggttttcagatggacagattgagtaaaaatttgttttttctgtctttcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagccgccgccgccgcctctgttgccgctaacactgtgcttggaatgggttactatggaagtatcgtggctaattccacttcctctaataacccttctaccctgactcaggacaagttacttgtccttttggcccagctggaggctttgacccaacgtctgggtgaactttatcagcaggtggccgagttgcgagtacaaactgagtctgctgtcggcacggcaaagtctaaataaaaaaaaattccacaatcaatgaataaataaacgagcttgttgttgatttaaaatcaagtgtttttatttcatttttcgcgcacggtatgccctagaccaccgatctcgatcattgagaacacggtggattttttccagaatcctatagaggtgggattgaatgtttagatacatgggcattaggccatctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggaggggtgcattcggggtgaaattatgtgcattttggattggatttttaagttggcaatattgccgccaagatctcgtcttgggttcatgttatgaaggaccaccaagacggtgtatccggtacatttaggaaatttatcgtgtagcttggatggaaaagcgtggaaaaatttggagacacccttgtgtcctccgagattttccatgcactcatccatgataatagcaatggggccgtgggcagcagcgcgggcaaacacgttccgtgggtctgacacatcatagttatgttcctgagttaaatcatcataagccattttaatgaatttggggcggagagtacccgattggggtatgaatgttccttcgggccccggagcatagttcccctcacagatttgcatttcccaagctttcagttccgatggtggaatcatgtccacctggggggctatgaagaacaccgtttctggggcgggggtgattagttgggatgatagcaagtttctgagcaattgagatttgccacatccggtggggccataaatgattccgattacaggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggttttagaccgtcagccatgggcattttggagagagtttgctgcaaaagttctagtctgttccacagttcagtgatgtgttctatggcatctcgatccagcagacctcctcgtttcgcgggtttggacggctcctggagtagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcattctgctggtggagaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacagcttgggcgcaaggaaaatggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtatccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatttggtcagaaaacacaatttttttattgtcaagtttggtggcaaatgatccatacagggcgttggataaaagtttggcaatggatcgcatggtttggttcttttccttgtccgcgcgctctttggcagcgatgttgagttggacatactcgcgtgctaggcacttccattcggggaagatagttgtcaattcatctggcacgattctcacttgccaccctcgattatgcaaggtaattaaatccacactggtggccacctcgcctcgaaggggttcgttggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcacgctcatatgggttaaggggactgccccagggcatgggatgggtgagtgcagaggcatacatgccacagatgtcatagacgtagatgggatcctcaaagatgcctatataggttggatagcatcgcccccctctgatacttgctcgcacatagtcatatagttcatgtgatggcgctagcaaccccggacccaagttggtgcgattgggtttttctgttctgtagacaatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgcagcgaagcgtgagtaagggcgaaggtgtctctgaccatgactttgagaaattggtatttgaagtccatgtcgtcacaggctccctgttcccagagttggaagtctacccgtttcttgtaggcggggttgggcaaagcgaaagtaacatcgttgaagagaatcttaccggctctgggcataaaattgcgagtgatgcggaaaggctgtggtacttccgctcgattgttgatcacctgggcagctaggacgatctcgtcgaaaccgttgatgttgtgtcctacgatgtataattctatgaaacgcggcgtgcctttgacgtgaggtagcttattgagctcatcaaaggttaggtctgtagggtcagataaggcgtagtgttcgagagcccattcgtgcaggtgaggatttgcatgtaggaatgatgaccaaagatccaccgccagtgctgtttgtaactggtcccgatactgacgaaaatgctggccaattgccattttttctggagtgacacagtagaaggttctggggtcttgttgccatcgatcccactttagtttaatggctagatcgtgggccatgttgacgagacgctcttctcctgagagtttcatgaccagcatgaaaggaactagttgtttgccaaaggaccccatccaggtgtaagtttccacatcgtaggtcaggaagagtctttctgtgcgaggatgagagccgatcgggaagaactggatttcctgccaccagttggaggattggctgttgatgtgatggaagtagaagtttctgcggcgcgccgagcattcgtgtttgtgcttgtacagacggccgcagtagtcgcagcgttgcacgggttgtatctcgtgaatgagctgtacctggcttcccttgacgagaaatttcagtgggaagccgaggcctggcgattgtatctcgtgctcttctatattcgctgtatcggcctgttcatcttctgtttcggtggtggtcatgctgacgagcccccgcgggaggcaagtccagacctcggcgcgggaggggcggagctgaaggaccagagcgcgcaggctggagctgtccagagtcctgagacgctgcggactcaggttagtaggtagggacagaagattaacttgcatgatcttttccagggcgtgcgggaggttcagatggtacttgatttccacaggttcgtttgtagagatgtcaatggcttgcagggttccgtgtcctttgggcgccactaccgtacctttgttttttcttttgatcggtggtggctctcttgcttcttgcatgctcagaagcgatgacggggacgcgcgccgggcggaagcggttgttccggacccggaggcatggctggtagtggcacgtcggcgccgcgcacgggcaggttctggtactgcgctctgagaagacttgcgtgcgccaccacgcgtcgattgacgtcttgtatctgacgtctctgggtgaaagctaccggccccgtgagcttgaacctgaaagagagttcaacagaatcaatttcggtatcgttaacggcagcttgtctcagtatttcttgtacgtcaccagagttgtcctggtaggcgatctccgccatgaactgctcgatttcttcctcctgaagatctccgcgacccgctctctcgacggtggccgcgaggtcattggagatacggcccatgagttgggagaatgcagtcatgcccgcctcgttccagacgcggctgtaaaccacggccccctcggagtctcttgcgcgcatcaccacctgagcgaggttaagctccacgtgtctggtgaagaccgcatagttgcataggcgctgaaaaaggtagttgagtgtggtggcaatgtgttcggcgacgaagaaatacatgatccatcgtctcagcggcatttcgctgacatcgcccagagcttccaagcgctccatggcctcgtagaagtccacggcaaaattaaaaaactgggagtttcgcgcggacacggtcaattcctcctcgagaagacggatgagttcggctatggtggcccgtacttcgcgttcgaaggctcccgggatctcttcttcctcttctatctcttcttccactaacatctcttcttcgtcttcaggcgggggcggagggggcacacggcgacgtcgacggcgcacgggcaaacggtcgatgaatcgttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcgcgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaacccgcgcattggttgtaccagtgccaagtcagctacgactctttcggcgaggatggcttgctgtacttgggtgagggtggcttgaaagtcatcaaaatccacaaagcggtggtaagccccggtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaacctataagaaaatgcggcggtggttggcggtagagaggccatcgttctgtagctggagcgccgggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggttgccgaatggcagggaagtgagtcctattttttttttttgccgctcagatgcatcccgtgctgcgacagatgcgtccccaacaacagcccccctcgcagcagcagcaaccacaaaaggctgtccctgcaactactgcaactgccgctgtgagcggtgcgggacagcccgcctatgatctggacttggaagagggcgaaggactggcacgtctaggtgcgccttcgcccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggacagaagacgagtgttgcgggacgaggatttcgaagttgatgaagtgacagggatcagtcctgccagggcacacgtggctgcagccaaccttgtatcggcttacgaacagacagtaaaggaagagcgtaatttccaaaagtcttttaataatcatgtgcgaaccctcattgcccgcgaagaagtcacccttggtttgatgcatttgtgggatttgatggaagctatcattcagaaccctactagcaaacctctgaccgcacagctgtttctggtggtgcaacacagcagagacaatgaggctttcagagaggcgctgctcaacatcaccgaacccgaggggagatggttgtatgatcttatcaacattctacagagtatcatagtgcaggagcggagcctgggcctggccgagaaggtggctgccatcaattactcggttttgagcttgggaaagtattacgctcgcaagatctacaagactccatacgttcccatagacaaggaggtgaagatagatgggttctacatgcgcatgacgctgaaggtgttgaccctgagcgatgatcttggggtgtaccgcaatgacagaatgcatcgcgcggtgagcgccagcaggaggcgcgagttaagcgacagggaactgatgcacagtttgcaaagagctctaactggagctggaaccgagggtgagaattactttgatatgggagctgacttgcagtggcagcctagtcgcagggctctgaacgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgcgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtatatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcattggtgctaccgcggctgagcccgagtctgcaagtccttttcctagtctacccttttctctacacagtgtacgtagcagcgaagtgggtagaataagtcgcccgagtttaatgggcgaagaggagtacctaaacgattccttgctcagaccggcaagagaaaaaaatttcccaaacaatggaatagaaagtttggtggataaaatgagtagatggaagacttatgctcaggatcacagagacgagcctgggatcatggggactacaagtagagcgagccgtagacgccagcgccatgacagacagaggggtcttgtgtgggacgatgaggattcggccgatgatagcagcgtattggacttgggtgggagaggaaggggcaacccgtttgctcatttgcgccctcgcttgggtggtatgttgtaaaaaaaaataaaaaagaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttactcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaaaaccatcatgcatactaacatgcccaacgtgaacgagtatatgtttagtaacaagttcaaagcgcgtgtgatggtgtccagaaaacctcctgagggtgttagagtagacgataattatgatcataagcaagatattctaaaatacgagtggttcgagtttactttgccagaaggcaacttttcggtcactatgactatcgacttgatgaacaatgccatcatagacaattacttgaaagtgggcagacagaatggagtgttggaaagtgacattggtgttaagttcgacactaggaacttcaagttgggatgggatccagaaactaagttgatcatgcctggggtttacacctatgaggccttccatcctgacatcgtattgctgcctggctgcggagtggactttaccgaaagccgtctgagcaaccttcttggcattagaaagaaacacccattccaagagggttttaagatcttgtatgaggatttagaaggaggaaatattccagcccttttggatgtagatgcttatgagaacagcaagaaagatcaaaaagccaaaatagaagctgctgcagaagctaaagcaaacatagttgccaacgatccggtaagggtggctaacgctagtgaaatcaggggagacagttttgccgcaacatccgttccgactaaagaatcattattggatgatgtgtctcaaaacatagagttaaaactcactattaagcctgtggaaaaagatggcaaaaacagaagttacaatgtgttggaagataaaatcaacacggcctatcgcagttggtacctttcgtacaattatggcgaccccgaaaaaggagtgcgttcctggacattgctcaccacctcagatgtcacctgcggagcggagcaggtctactggtcgcttccagacatgatgcaggatcctgtcactttccgctccactagacaagtcagtaactaccctgtggtgggtgcagagcttatgcccgtcttttcaaagagcttctacaacgaacaagctgtgtactcccagcagctccgccagtccacctcgcttacgcacgtcttcaaccgctttcctgagaaccagattttaatccgtccgccggcgcccacaattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaaaatgtccgttcttatctcgcccagtaataacaccggttggggtctgcgcgctcccagcaagatgtacggaggcgcacgcaaacgttctacccaacatcccgtgcgtgttcgcgggcattttcgcgctccatggggtgccctcaagggccgcactcgcgttcgaaccaccgtcgatgatgtaatcgatcaggtggttgccgacgcccgtaattatactcctactgcgcctacatctactgtggacgcagttattgacagtgtagtggctgacgctcgcaactatgctcgacgtaagagccggcgaaggcgcattgccagacgtcaccgagctaccactgccatgcgagcagcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggtaaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcagctgaccgattaggcgagtttgcttatggcaagcgtagtagaataaatcccaaggatgaaacagtgtccatacccttggatcatggaaatcccacccctagtcttaaaccggtcactttgcagcaagtgttacccgtaactccgcgaacaggtgttaaacgcgaaggtgaagatttgtatcccactatgcaactgatggtgcccaaacgccagaagttggaggacgttttggagaaagtaaaagtggatccagatattcaacctgaggttaaagtgagacccattaagcaggtagcgcctggtctgggagtacaaactgtagacattaaaattcccactgaaagtatggaagtgcaaactgaacccgcaaagcctactgccacctccactgaagtgcaaacggacccatggatgcccatgcctattacaactgacgccgtcggtcccactcgaagatcccgacgaaagtacggtccagcaagtctgttgatgcccaactatgtcgtacacccatctattattcctactcctggttaccgaggcactcgctactatcgcagccgaaacagtacttcccgccgtcgccgcaagacacctgcaaatcgcagtcgtcgccgtagacgcacaagcaaaccgattcccggcgccctggtgcggcaagtgtaccgcaatggtagtgcggaacctttgacactgccgcgtgcgcgttaccatcctagtatcatcacttaatcaatgttgccgctgcctccttgcagatatggccctcacttgtcgccttcgcgttcccatcactggttaccgaggaagaaactcgcgccgtagaagagggatgttggggcgcggaatgcgacgctacaggcgacggcgtgctatccgcaagcaattgcggggtggttttttgccagccttaattccaattatcgctgctgcgattggcgcaataccaggcatagcttccgtggcggttcaggcctcgcaacgacattgacattggaaaaaaaaaaaacgtataaataaaaaatacaatggactctgacactcctggtactgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggtatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagcccctatggccaccggggtgatgaaaccttctcagttgcatcgacccgtcaccttggatttgccccctcctcctgctgctactgctgtacccgcttctaagcctgtcgctgccccgaaaccagtcgccgtagccaggtcacgtcccgggggcgctcctcgtccaaatgcacactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcatcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcctaccgtagcgccgacccacgatgtgaccaccgatcgtagccagcggctcatgttgcgcttcgtgcccgttgaccgggaggacaatacatactcttacaaagtgcggtacaccctggccgtgggcgacaacagagtgctggatatggccagcacgttctttgacattaggggcgtgttggacagaggtcccagttttaaaccctattctggtacggcttacaactccctggctcctaaaggcgctccaaatgcatctcagtggttggataagggagttacaagcactggcctagtggacgacggcaatactgatgatggggaagaagccaaaaaagcaacatacacttttggtaatgctccagtaaaagccgaggctgaaatcacaaaagacggattgccggtgggcttggaagtttcaactgaaggtcctaaaccaatctatgctgataagctttatcagccagaacctcaagtgggagacgaaacttggactgacctagacggaaaaaccgaagagtatggagggagggttcttaaacctgaaactaaaatgaaaccctgctacggatcttttgctaaacctactaatattaaaggaggtcaggcaaaggtaaaaccaaaagaagacgatggcactaacaacatcgagtatgacattgacatgaacttctttgacttaagatcacaaagatcagaactcaaacctaaaattgtaatgtatgcagaaaatgtggacctggaatgtccagatactcatgttgtgtacaaacctggagtttcagatgctagttctgagaccaatcttggacaacagtctatgcccaacagacccaactacattggcttcagagataacttcatcggacttatgtactataacagtactggcaacatgggggtactggctggccaagcgtctcagttgaatgcagtggttgacttgcaggacagaaacacagaactgtcttaccaactcttgcttgactctctgggcgacagaaccagatactttagcatgtggaatcaggctgtggacagttatgatcctgatgtacgtgttattgaaaatcatggtgtggaagatgaacttcccaactattgttttccgttggatggtgtcggtccgcgaacagatagttacaaggagattaagccaaatggagaccaatctacttggacaaatgtagacccaactggcagcagtgaacttgctaagggaaatccatttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtaaacatggttctacagagttccctcggtaacgacctacgggtagatggcgccagcatcagttttacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctacttcgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgtcaaggtcaaccctatcccgctaactatccctatccactcattggaacaactgccgtaaatagtgttacgcagaaaaagttcttgtgtgacagaaccatgtggcgcataccgttctcaagcaacttcatgtctatgggagcccttacagacttgggacagaacatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaacagcagctgcaaccatggcctgcggatcccaaaacggctccagcgagcaagagctcagagccattgtccaagacctgggttgcggaccatattttttgggaacctttgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccggtgtattacgctggaaaaatctacccagaccgtgcagggcccccgttctgccgcctgcggacttttctgctgcatgttccttcatgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttctcaatacccattcgccttattttcgctctcatcgtacacacatcgaaagggccactgcgttcgaccgtatggatgtgcaataatgattcatgtaaacaacgtgttcaataaacagcactttattttttacatgtatcgaggctctggattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctcccagcaggtcaggagccgaaatcttgaaatcacaattaggaccagtgctctgagcgcgagagttgcggtacaccggattgcagcactgaaacaccatcagcgacggatgtcttacgcttgccagcacggtgggatctgcaatcatgcccacatccagatcttcagcattggcaatgctgaacggggtcatcttgcaggtctgcctacccatggcgggcacccaattaggcttgtggttacaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcgcagccggcatcattcacacagcagcgggcgtcattgttggctatttgcaccacacttctgccccagcggttttgggtgattttggttcgctcgggattctccttcaaggctcgttgtccgttctcgctggccacatccatctcgataatctgctccttctgaatcataatattgccatgcaagcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgttcacgtactggtgacagatgcgcttgtattgttcgtgctgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttggcgatcttctcaatgcttcttttgccatccttctcaacgatgcgcacgggcgggtagctgaaacccactgctacaagttgcgcctcttctctttcttcttcgctgtcttgactgatgtcttgcatggggacatgtttggtcttccttggcttctttttcgggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagccagacatcgaacaagacccgggctatgtgacaccggtggaacacgaggaagagttgaaacgctttctagagagagaggatgaaaactgcccaaaacagcaagcggataactatcaccaagatgctggaaatagggatcagaacaccgactacctcatagggcttgacggggaagacgcgctccttaaacatctagcaagacagtcactcatagtcaaggatgcattattggacagaactgaagtgcccatcagtgtcgaagagctcagccgcgcctacgagcttaacctattttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcgtcgaggtcacacactttgcataccccgctgtcaacctgccccctaaagtcatgacggccgtcatggaccagttactcattaagcgcgcaagtcccctttcagaagacatgcatgacccagatgcctgtgatgagggtaaaccagtggtcagtgatgagcagctaacccgatggctgggcaccgactctccccgggatttggaagagcgtcgcaagcttatgatggccgtggtgctggttaccgtagaactagagtgtcttcggcgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcacccttaagggggaagcccgccgtgattacatccgcgattgtgtttatctctacctgtgccacacgtggcaaaccggcatgggtgtatggcagcaatgtttagaagaacagaacctgaaagagctaaacaagctcttacagaaatctcttaaggttctgtggacagggttcgacgagcgcaccgtcgcttccgacctggcagacctcatcttcccagagcgtctcagggttactttgcgaaacggactgcctgactttatgagccagagcatgcttaacaattttcgctctttcatcctggaacgctccggtatcctgcccgccacctgctgcgcactgccctccgactttgtgcctctcacctaccgcgaatgccccccgccgctatggagtcactgctacctgttccgtctggccaactacctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgccccggaagattaccacccctatgaaatcaagttctatgaggaccaatcacagcctccgaaagccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaagcaagaagttgaaggtgcagccgccgcccccagaagatatggaggaagattgggacagtcaggcagaggaagcggaggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggccaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacgtttatgagtaaagaaattcccacgccttacatgtggagttatcagccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagcgggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcactacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggattactatcgaaggcaaaatacactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcctagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcttattaagtgcggatgggaatgcaggtccgttgaaattacacacaataacaaaacctggaacaataccttatccaccacatgggagccaggagttcccgagtggtacactgtctctgtccgaggtcctgacggttccatccgcattagtaacaacactttcattttttctgaaatgtgcgatctggccatgttcatgagcaaacagtattctctatggcctcctagcaaggacaacatcgtaacgttctccattgcttattgcttgtgcgcttgccttcttactgctttactgtgcgtatgcatacacctgcttgtaaccactcgcatcaaaaacgccaataacaaagaaaaaatgccttaacctctttctgtttacagacatggcttctcttacatctctcatatttgtcagcattgtcactgccgctcacggacaaacagtcgtctctatccctctaggacataattacactctcataggacccccaatcacttcagaggtcatctggaccaaactgggaagcgttgattactttgatataatctgcaacaaaacaaaaccaataatagtaacttgcaacatacaaaatcttacattgattaatgttagcaaagtttacagcggttactattatggttatgacagatacagtagtcaatatagaaattacttggttcgtgttacccagttaaaaaccacgaaaatgccaaatatggcaaagattcgatccgatgacaattctctagaaacttttacatctcccaccacacccgacgaaaaaaacatcccagattcaatgattgcaattgttgcagcggtggcagtggtgatggcactaataataatatgcatgcttttatatgcttgtcgctacaaaaagtttcatcctaaaaaacaagatctcctactaaggcttaacatttaatttctttttatacagccatggtttccactaccacattccttatgcttactagtcttgcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatctaccactccagcaccccgcacaactactttctctagcagcagtgtcgctaacaatacaatttccaatccaacctttgccgcgcttttaaaacgcactgtgaataattctacaacttcacatacaacaatttccacttcaacaatcagcattatcgctgcagtgacaattggaatatctattcttgtttttaccataacctactacgcctgctgctatagaaaagacaaacataaaggtgatccattacttagatttgatatttaatttgttctttttttttttatttacagtatggtgaacaccaatcatggtacctagaaatttcttcttcaccatactcatttgtgcatttaatgtttgcgctactttcacagcagtagccacagcaaccccagactgtataggagcatttgcttcctatgcactttttgcttttgttacttgcatctgcgtatgtagcatagtctgcctggttattaattttttccaacttctagactggatccttgtgcgaattgcctacctgcgccaccatcccgaataccgcaaccaaaatatcgcggcacttcttagactcatctaaaaccatgcaggctatactaccaatatttttgcttctattgcttccctacgctgtctcaaccccagctgcctatagtactccaccagaacaccttagaaaatgcaaattccaacaaccgtggtcatttcttgcttgctatcgagaaaaatcagaaattcccccaaatttaataatgattgctggaataattaatataatctgttgcaccataatttcatttttgatataccccctatttgattttggctggaatgctcccaatgcacatgatcatccacaagacccagaggaacacattcccctacaaaacatgcaacatccaatagcgctaatagattacgaaagtgaaccacaacccccactactccctgctattagttacttcaacctaaccggcggagatgactgaaacactcaccacctccaattccgccgaggatctgctcgatatggacggccgcgtctcagaacagcgacttgcccaactacgcatccgccagcagcaggaacgcgcggccaaagagctcagagatgtcatccaaattcaccaatgcaaaaaaggcatattctgtttggtaaaacaagccaagatatcctacgagatcaccgctactgaccatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaatggaagcggagctactaacttcagcctgctgaagcaggctggtgacgtcgaggagaatcctggcccaatggtgagcaaaggcgaagagctgttcaccggcgtggtgcccatcctggtggagctggacggcgacgtgaacggccacaagttcagcgtgagcggcgagggcgagggcgacgccacctacggcaagctgaccctgaagctgctgtgcaccaccggcaagctgcccgtgccctggcccaccctggtgaccaccctgggctacggcgtgcagtgcttcgcccggtaccccgaccacatgaagcagcacgacttcttcaagagcgccatgcccgagggctacgtgcaggagcggaccatcttcttcaaggacgacggcaactacaagacccgggccgaggtgaagttcgagggcgacaccctggtgaaccggatcgagctgaagggcatcgacttcaaggaggacggcaacatcctgggccacaagctggagtacaactacaacagccacaacgtgtacatcaccgccgacaagcagaagaacggcatcaaggccaacttcaagatccggcacaacatcgaggacggcggcgtgcagctggccgaccactaccagcagaacacccccatcggcgacggccccgtgctgctgcccgacaaccactacctgagctaccagagcgccctgttcaaggaccccaacgagaagcgggaccacatggtgctgctggagttcctgaccgccgccggcatcaccgagggcatgaacgagctctataagtaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccagacggagttcttactttaaaatgtttaaccccactaacaaccacaggcggatctctacagctaaaagtgggagggggacttacagtggatgacactgatggtaccttacaagaaaacatacgtgctacagcacccattactaaaaataatcactctgtagaactatccattggaaatggattagaaactcaaaacaataaactatgtgccaaattgggaaatgggttaaaatttaacaacggtgacatttgtataaaggatagtattaacaccttatggactggaataaaccctccacctaactgtcaaattgtggaaaacactaatacaaatgatggcaaacttactttagtattagtaaaaaacggagggcttgttaatggctacgtgtctctagttggtgtatcagacactgtgaaccaaatgttcacacaaaagacagcaaacatccaattaagattatattttgactcttctggaaatctattaactgatgaatcagacttaaaaattccacttaaaaataaatcttctacagcgaccagtgaaactgtagccagcagcaaagcctttatgccaagtactacagcttatcccttcaacaccactactagggatagtgaaaactacattcatggaatatgttactacatgactagttatgatagaagtctatttcccttgaacatttctataatgctaaacagccgtatgatttcttccaatgttgcctatgccatacaatttgaatggaatctaaatgcaagtgaatctccagaaagcaacatagctacgctgaccacatccccctttttcttttcttacattacagaagacgacaactaaaataaagtttaagtgtttttatttaaaactcacaaaattcgagtagttattttgcctccaccttcccatttgacagaatacaccaatctctccccacgcacagctttaaacatttggataccattagagatagacattgttttagattccacattccaaacagtttcagagcgagccaatctggggtcagtgatagataaaaatccatcgcgatagtcttttaaagcgctttcacagtccaactgctgcggatgcgaatccggagtctggatcacggtcatctggaagaagaacgatgggaatcataatccgaaaacggtatcggacgattgtgtctcatcaaacccacaagcagccgctgtctgcgtcgctccgtgcaactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacagccacactcttaagttggtcaaaagaatgctggcttcagttgtaatcaaaactccatcgcatctaattgttctgaggaaatcatccacggtagcatatgcaaatcccaaccaagcaatgcaactggattgcgtttcaagcaggagaggagagggaagagacggaagaaccatgttaatttttattccaaacgatctcgcagtacttcaaattgtagatcgcgcagatggcatctctcgcccccactgtgttggtgaaaaagcacagctaaatcaaaagaaatgcgattttcaaggtgctcaacggtggcttccaacaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacaggtggataaatcagtctttccatcacaagacaagccacagggtctccagctcgaccctcgtaaaacctgtcatggtgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacgcacaagctctaaagtcactctccaacctctccacaatatatatacacaagccctaaactgacgtaatgggagtaaagtgtaaaaaatcccgccaaacccaacacacaccccgaaactgcgtcaccagggaaaagtacagtttcacttccgcaatcccaacaagcgtcacttcctctttctcacggtacgtcacatcccattaacttgcaacgtcattttcccacggccgcgccgccccgtttagccgttaaccccacagccaatcaccacacaccccacaatttttaaaatcacctcatttacatattggcaccattccatctataaggtatattattgatgatg

The invention claimed is:

1. A method for measuring replication kinetics of a recombinant adenovirus, comprising:
   (i) transfecting cells with the genome of the recombinant adenovirus, or infecting cells with particles of the recombinant adenovirus,
      wherein the recombinant adenovirus comprises a recombinant adenovirus genome comprising a heterologous opening reading frame (ORF) encoding a fluorescent protein, and a self-cleaving peptide coding sequence, both operably linked to and in the same reading frame as an endogenous adenovirus ORF, wherein the self-cleaving peptide coding sequence is located between the heterologous ORF and the endogenous ORF, and wherein:
      (a) the endogenous ORF is E1B-55k and the heterologous ORF is 3' of E1B-55k;
      (b) the endogenous ORF is DNA polymerase and the heterologous ORF is 5' of DNA polymerase;
      (c) the endogenous ORF is DNA-binding protein (DBP) and the heterologous ORF is 3' of DBP;
      (d) the endogenous ORF is adenovirus death protein (ADP) and the heterologous ORF is 5' of ADP;
      (e) the endogenous ORF is E3-14.7k and the heterologous ORF is 3' of E3-14.7k; or
      (f) the endogenous ORF is E4-ORF2 and the heterologous ORF is 5' of E4-ORF2;
   (ii) culturing the transfected cells or infected cells for at least two days;
   (ii) measuring fluorescence at regular intervals throughout the culture period; and
   (iv) calculating log-slope from the fluorescence measurements, thereby measuring replication kinetics of the recombinant adenovirus.

2. The method of claim 1, wherein the recombinant adenovirus further comprises a second heterologous ORF.

3. The method of claim 1, wherein replication kinetics of the recombinant adenovirus is measured in a first cell type and a second cell type.

4. The method of claim 3, wherein the first cell type is a tumor cell and the second cell type is a non-tumor cell.

5. The method of claim 1, comprising transfecting cells with the genome of the recombinant adenovirus.

6. The method of claim 5, wherein transfection results in approximately 5-10% of cells transfected.

7. The method of claim 1, comprising infecting cells with particles of the recombinant adenovirus.

8. The method of claim 7, wherein the cells are infected with serial dilutions of the recombinant adenovirus particles.

9. The method of claim 1, wherein the endogenous ORF is E3-14.7k and the heterologous ORF is 3' of E3-14.7k.

10. The method of claim 1, wherein the endogenous ORF is ADP and the heterologous ORF is 5' of ADP.

11. The method of claim 1, wherein the endogenous ORF is E1B-55k and the heterologous ORF is 3' of E1B-55k.

12. The method of claim 1, wherein the self-cleaving peptide is a 2A peptide or variant thereof.

13. The method of claim 12, wherein the 2A peptide comprises a porcine teschovirus-1 (PTV1) 2A (P2A) peptide, a foot and mouth disease virus (FMDV) 2A (F2A) peptide, an equine rhinitis A virus (ERAV) 2A (E2A) peptide or a Thosea asigna virus (TaV) 2A (T2A) peptide, or a variant thereof.

14. The method of claim 13, wherein the amino acid sequence of the self-cleaving peptide is at least 80% identical to the amino acid sequence of any one of SEQ ID NOs: 12-19.

15. The method of claim 13, wherein the self-cleaving peptide comprises the amino acid sequence of any one of SEQ ID NOs: 12-19.

16. The method of claim 1, wherein the fluorescent protein is a green fluorescent protein (GFP) a yellow fluorescent protein (YFP), a red fluorescent protein (RFP) or a blue fluorescent protein (BFP).

17. The method of claim 16, wherein the YFP is YPet or the RFP is mCherry.

18. The method of claim 1, wherein the recombinant adenovirus genome comprises in the 5' to 3' direction:
   E1B-55K-P2A-YPet;
   E1B-55K-P2A-mCherry;
   YPet-P2A-(DNA polymerase);
   DBP-P2A-YPet;
   YPet-P2A-ADP;
   E3-14.7k-P2A-YPet;
   YPet-P2A-E4-ORF2; or
   mCherry-P2A-E4-ORF2.

19. The method of claim 1, wherein the recombinant adenovirus genome comprises the nucleotide sequence of any one of SEQ ID NOs: 3-7, 9-11, 20 and 21.

20. The method of claim 1, wherein the recombinant adenovirus genome comprises in the 5' to 3' direction YPet-P2A-ADP.

21. The method of claim 20, wherein the recombinant adenovirus genome comprises the YPet-P2A-ADP sequence of adenovirus CMBT-403, wherein adenovirus CMBT-403 has a genome of SEQ ID NO: 7.

* * * * *

UNITED STATES PATENT AND TRADEMARK OFFICE
CERTIFICATE OF CORRECTION

PATENT NO. : 11,130,968 B2
APPLICATION NO. : 16/109513
DATED : September 28, 2021
INVENTOR(S) : O'Shea et al.

Page 1 of 1

It is certified that error appears in the above-identified patent and that said Letters Patent is hereby corrected as shown below:

In the Claims

Column 25, Line 9, Claim 1(i), "opening reading frame" should read --open reading frame--

Signed and Sealed this
Twenty-ninth Day of March, 2022

Drew Hirshfeld
*Performing the Functions and Duties of the*
*Under Secretary of Commerce for Intellectual Property and*
*Director of the United States Patent and Trademark Office*